United States Patent 9,567,581 (SELECTIVE REACTIVATION OF GENES ON THE INACTIVE X CHROMOSOME) - sequence listing, part 55

SEQ ID NO: 5684 - DNA, 154568 bp, human
gaggctttcgactgagggctagcgaggggagcacggctggagcagggctggagcagggctggagcagggctggagcagggctgaagcagggccgcggaccccgcacgctcctgcgggccccgcggagccattgcggccgaggtgagcgtctatccctgggctggagggcgagctctgtacgcgcggccgttctcggtttctcgcgggtggcagtggcgaggttggggggggagttcccacgggaccctgcgcggaggcgcggaggtggcggccttggggagcctgcgggaaaggctgctggaggggcatggcggcctgccccaaccctccctgaaccccgcctcctctcccctcccccaggcctcggcaggcgccagcggagagctagccgcatcttcgggggcagcccggcagctgccggcggcgcggcgagagagcggctgacagaggggatgcgaggtaccggcattagccatggccaagtggccctaaagagagagtagaggccgggccttcagcgtttctcactggttcgaggaaggcggcctcagaggagagggaaggtgaggggcgggcaggcaggcttcgcgggtaactactaggcgttgcatatatatgttttgatatctaaatggtactacacacacacacacattcatttcgactaactgcttgtttaaaaatctgagaatatgtcttgtagatcttcttatatccgggaatccaaatttatgttgggttttaaacagctgcattgtatgattgtactacagtttatttaaccatttcccgattgatatacattagcttgtttctctgttgggggagggaggggactattacaagcaatgccataatgaatgggtttgtgtatatgtatcatgccatgtatgagtatttctgtaggagaaattcttagaagagtaaccgctgggtcagggtgtatatgcattttgaattttgatagatttgtccaaattgccttcccaaaagcctgtactaatttacactctttaatgttgtgcgagagtgcctatttttccacagttatgccaacacgtattatcaatctttgtaattttagccaatttaaagggcaaaaaaatcgtatgtcattgttttcatttgcatttccctgattactggcgaaattgatcatatttttgtttgtaaataggcaaatatcaatagtttatataggcagttttcctatctataagcaataagcattttgaaattttaataataaaaaacctgttcgcaatagcaagagaaacgaataaaaatacctagaagtaaactataaaactttattgacgaataccataaaagaacatctgcatgaaaagagaaggaatactatgcttctgaataagaaggctcaatattttagtgatgtccatttttcctatattggtttatacagttgatgcaatttcaataaatataccaagtttttttggaacttactatgattctaaagttcatccgggggaaaaaaatggctaagaataactgaaaaaaaatattttaaaacgtaagtaaagatagggatatttgtactactggctattaaaatgtactctaaaggaactatttaaattagaacggacagaacaatgcattagaatggaaaagcccacaaatcaagccagattggatcccaagatttattggagaaacactgttggctagacgtggaaaaactgccatattaaaagcttcaggcatttccccccatccccgaagcttgaatattcctttgagggcagactcctttgtttggagaaaaccactttattggatctttttggttatgccaaggtaaagcttcagtagttaaaattggtggctttggaactagaactaatgatatggcctttagttagattaagatggattcaggttagcctgcagtgcggcgagggaaggagtctggataatgtaggtttaaaaatttttttccctatctaatgggcaaaaaatgttatgtcattgttttcatttgcatttgtgtgcttactgtgagattgaacgtcttttaaatgttagtccaggataatatgttattcctggagacaggtaacaatgggggactctttgctccgcttccagaatggagtttggctaattggtacagccttgcccggaagcgtgagaataaacaggttgactttttaaattttcctcaagcactaggctctagacacctagatcgggggcggaggcagttttcaggacatggccgagatttggcgctgagctgtgtcatcgcgaggtttggcagccagctccgcagtgggtcggaaacctcgtggtaggcgagatccctgcaggacgggagggttcctcccttcccccgaaaaactcccagtcattttcatgaagctccgcctttctcctttttaggagtgtgcaccaggtctcgcgatatctcatgtttcctaaaggcgaggcgcgggcggcatcctgcggtgaattaagaaggtctcgccgaggctaaagcgtaatatcgcgatagttctcaacgcatgcgggagccggccgtggtaggttggctccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtagctcgcgggtggggggtgggggggcagtgactagggtcggtccgcctgctgttaagatggcggcggaggctgatgtctgtccggccaggacccagcacagaggtgttggctatctgcctttatgacgcctctgaggtgcccagcgttaaggaggtgacgattggcgaaacgccggggtgccggtaaactagacctgaggcgaagaccacctcgtttcttgtccgttgaggcgacaccatttcctgggcctcggccgcgtgtgggcccgcctttgccccaccgatcggtcaacgcctccgttgtcgccgccgcagtgggcggattgggaagggtgggaggggagtctggagttcgctggggagtggggttgggggttaaattgaacggtgggaaagaggagcaaccaatgaagagtggcccctttcccctaccttttctgccggccaacctccgttctcagcacctccgacgacccggatgaataccctggtttttctcgaggtggggtcatcttcgccaactctcgcggttttagagctaaggcttagggttcaagcagtagtgtcactggtgtactcctcctcctctccccacacccctcctaattctgtcgtcccatctaatcttcatctacgtggatagttgaggctggtatttaagggaggggggagtcaaagcttttccctgtgactccttccccagttctaaattcgagtttagcctaagtcctctagcccgctctgtctcccccttccattggtccccttggcgcaggcgttgaatagagcttatcctgttgcctgcatttactccatctttgtggatggtgccatagtagccttccatttccttaagtcttcatgtttgtatgactctgatccggatttcttagctctgcatgctgctaaaccactattaagcgaaactatgaacgggtcggtgtttggatattgcagtttaagtggccttttcgtttacggccattagccttgccttcctcattcctccccctcagaaggctgtagaggataactctccagtaaacccgctttctgtcttccctgcctcttccatttcccctgcaagcctgggaaccgccccttttccctgccttgctctgagtttctggagcctcttggtctgtggacatctatttttgctgctgagcacctcttacctgcttctcacttcttaatctttctatcccccactccccatactccttttccaggagctgaatcccttagaaggaagataaccctcctctcaggctccactacattttaccccttccatttactagaaaacagcattgattgtcctgccccccagtctgccctgttctttatttcctcttccccccatgccaccgttactataggcagttaattccctatcatttgtttctcctttgtagattacatgttcagcattgttttcttttagccccagtgttgcatagattgaggagataccaacattccccagtcataggcggcggtctggtatggtgaaattaatagtgtgtgttttgggtgtgttttgggttcacattgaaccttgtgaccttgggcaaattttcagattctcagttcatctatataatgggaatagttgtgcttacattagaggattgttgctagaattagttaaaataaaataaaataaaatgtttagctcatggtaggcacataataaattaggattactttttggtgtaagaatgcattggtagatgtacctgtgtcatatgctaattttatgacctgggaaagagtaagagatttttgtttctttaactgtacattcttggtgtatttctaggccagatctataacgtttatattttttttcctcataggccaaactttttatctccagtggttcatgatgtttgaacgtgattcccactctttgtttccttctaatggtctaggaatttcagtgcgtaatcactatcctggaatgaccaccagccataatgttcctgtcaagaaccacacccaagtgttctaccttttggaaggggtgcctcatgccctgcctactcatttcttccactccttcaaaggcagtctgtcctgtcattcactctacaaaagtaatttggtgtcatgcatttcacagtggtaaaaggaacttctgttagctagttttgaagtattcatgctacttttcacctccctcatttgtttggttcctcagatcagtgtggggatctgctatttggcatcttcttacctgagcaagataattcctgtccgagagagaaagatcatttggaatacccagcttcttttccatagcaaattactgctggctctttaatacactacttcctgttgtgttattgccattttatattttctaacgtacttattaaacagatgtgactatttgacttggagaaagttttccttacttttttttttttttttttaagatggagtcttgctctcgccaggctggagtgcagtggcgcgatctcggctcactgcaacctccgcctcctgggttcaagcgatttacctgcctcagcctcccgagtagctgggactacaggcgcgcgccaccatgcccagctaatttttgtatttttagtaaagacggagtttcaccacgttggccaggatggtctcgatctcctgacctcgtgatccgcccgcctcggcctcccaaagtgctgagattacaggcttccttactgttaatatattgattagaccaatattaaagtgtagcattttacaattttttttttaactaattctagcaacaaccctttaatacaagcacaactatccccattattttacttcggctgggtgatgggaattgaagtagaaacgtggtgaaaagtttactaggatttaaaatttacaggaggtaaccatcccacaattagctgtatgtggactctagtttcgaacttcagggtctgctttatttaatttgaagtgctttgtaggtaataaaattttcttccattttcattggagggcaggaaatcactttctgttttgagattttgcattggtgcattttaccgtgggttaagcagtgatcacaaatttattaaacctcaatttcaatttgacccttattgagcaatagaataaatctgggaatgataatctaggtgtgacctaaaagtttaacttattctaggtagatctctgagaagagaggaaggagtgacaataccaaataaaaactttgtctaaggttcaatggcaaagttcaacctgagttgccaggatgtttatcgtttgtctcccaatatggccaaaaagcatgtatgaaggtgaagaataatttttatatgtacagttgttgttttttttcacagaaacaatgaaacaaatacgtccttagtgtttatattgagggtataaacttgtctaaaaaataaactgtcttctataatttcatttgggttgagaactcagttttcaggaatgttgtctaagcgttagaagtattagagttgttggttctgaattcctcagttacttctcaaagcaggtcctaaaaaatgcaaatagatatgtaaggactattgctttagaaataataactagttatgtttgaacataatagaatggttaaccctcctcacacaccctaataaatgtgttgtgtatctcactcctctcccccaactttttttttgtaggtcctccagcagcctgacctgagtgggttagtgatccagagaaaccagcaggccaacttggtcaggaaggttcgggaagctgttggagcagtgtggggaatttcccaccaggatgagtatgattggctgtgattttaggttagtttttgtaaatcttgtgggaagtatttgtattttacttcctggaatggagatagtaggggtggatgtattcccattctgtaatggagctactttggtttcttccattctctggatctgatgtggtactggttgcttctttttttaaagtggagctcattactgaattaaagggaattgtttaaatgaatgatgtctgtacatgattttttaaatcaccctaggcatcgttcaaaaaataaaattgcaagtcattatgtctaaccagttcttattaaagttacgaaaaatttcaaacatgcaaacattgaatagtataataatccccccacttacccatcaccagctttaatagtatcaacttgcacattctatttcatctatacttctgtttgtttggttttttttaatttttttaaattgagatggggtttcatcgtgttgcctagactggtcacaaactcctgggctcaagccatcctcccttcttggcctcccaaagtgttgggattacaggcgtgagccaccaggcccagcctgtttcatctatacttctaaccactgcccccctcaatggattatattggaataaatccctgtcatatttatttgtaaaatacttgtttgtatttctaaaaggcaagggctctttaaatataagatcaaaactattatcacaactgaaaaaattaacagatatttaaaaatatcaaatataaaatgttcagatttctgatttttttttaagctttgttttttttcttttacagtttgtttgaatcaggatcctgagaaagcacatttattgcaaagcattgatacagctgttaaatctattttaatctgcaggttctgtcttttgttttttttttcttccaatttatttgttgaagaaattgtcctatatatagtttcccgccccccatatttggggattacagcccagtagtggtgtctaacccattcttgctcaattaaagaccctggaggacccattataatggaacaatggctataatctcctgtatcctagttggagttgatagtgctgtcataggcactatcctaaaataactagtcatggattcctttttctgtggcaaagtctgatttgatacctgacttcagttccatgtcttggccttgctcattgctccacatgaaaagtaggcctcctggtggaagaagctagtgtttcctaatgacctgattgtgcctttggggtttttcatgcatggtttcaatttccttaggtgatttagttatttttatactactttataatgttgctttttattcttttgatgttagtgtctcagctgttctgacccataacttctaagctattaagacctaataatgagttcctggctgtcatacagttcttgaaatggcaatactaaaacagtttttgagagcttctacttacatgttgattttcagctattatacacaaccttagttttcctactgtgatttttcatttcatttcatctgaaatttatgtttccttagcataaagtcctttaaggacttttaggctgctttatgatgatctcactatctataaggttgatattcataagtacttgggcttttggtgttttgctgtattattcgttgtttcctcaacgactggttactagatgtttatatatgttaatgtcaggaataactcaacttttaagtcgtttgatgtttcataggtggtgttgttaaaacttgatgtacttgttgaccagcttggtcttctggatatagaaatcctttcaggtagtgaagaagtggctctatgagtaaaacaactgtaggttttgtttgggctgttaacctgagcattttcaacttttaagttctctttaaaagtttttagtcatttggctttaaaaattacagttggtggcatagaatgatcccataatgtgattttacagaaagttggaatgttttaatttattatgaatgtaccattacgtggagattgggattgtagatctgattcagtctggattgctgattgaactagatgaatgttaaaattcttcaactctgagattctgatggtataatcttaggtattgaaagacagcagtttttcctttcagtagtcattaagtaaatggtgactaaaagtagggagatgaattattctggaatgacctttcactataaccatttagatttaaaagattgatgagtctgaggatactgtcatgaatttatgtaccacctttagcacaatccaggttttaggtccttgtgattagatatcagagataattgccccagaagtgcgtgggtatattacatttggtggctgttaatgttttggaatgattttggaagattactttgggtacattatttgctatgattattttcttatattcctgtctattttatagtgaggcatgtttctcctggtctttgctttttttttttttttttttaaacttccaatattctttattacggcattctgacaattgagttcttacaggtggaaagacctttcagcacagcgattaagaacatggactctggagctagattcacagagttcaagttctgactcccatttcttaccaggtgtgtcatgttgtgcaaattacttaactgctttgtgccacacggtccttcatctgtaaaatgatgataatactgcctgccttatagagttctgaagaaatttagctgagttaatgcatataaagtgcttagaacaatggttctgaaactttagggaacatcagaatcacctagaggacttcctaaaagattggctggtccccactcccagagtttctgattctgtagatctaggaggggccccagattttgcatttctgataagttcccaggtgatacttctctatttcctgcaaattggcagctggatccagagacttgataaatttcaggttcgttccctttggcaaatatattgcgggggggtggggtgggggggtgttcattcacaacattgattatgttacgatgacttgaattttttggatccattaatttgttggggggctacaaaatggtgacgttctgatgctatcattttgttttcatctgttagctggaataattttgtttcccctcatcttttatttggttactcagcaatatagtttatataggaagagcaggataaatactcaattttttaaaacattgctttcaagatgatgaattggtcccctgtcatcttcaaaaggttacacatataagtgtatatataactatgcatccatagatgtaaacatttgatgggtttcaatacattgcagttctgatccttagcgaagttcaaattgcccttcttgtggctagtggaactctcttaaagttggctcctgattcttactgacatgctctctagtagtctttgatagcttccttgctatctggtatgtcaagatgtttccaggcgcattcttgtgcatttctgccccagacctggaattagctaatgggattaagataaaaggtgaagtcaaaagaaattctgtttttgccaagggtagcttggaactttctatcaagttccacttttctctttccacttaacctccctagcctgcctcttcattcttctctacctttttattagagttaaggtggaaaggtttgagaagccttgataatcataggaagatcatggagcccaggcagttccggatttggggcctggccacttactaggtctgtcagtttgggcaagttaacctatatcagttatgatgtggggaaataccttattcatatggttattggaattaaagagaaaatgtaaggtgttagtacatggtaggtgatcagtagatggtaatttatttaatgtactattttacttaactccttcaacagctcagaggtgggcagtcagggtggtgaaaataatggccatttaacaaaatgtgtctggaccctttaggtctgtgtgggatcatcagtggtgaggcaggatagggtttgttcttgagttattttgggtctgagactttggccagtgataactgaatgttccatagagtagtttttcactttggaactccttaggagtcacatttataccctctgaagggtcttagctagttctgtaatgtgtattacattggttaccttgatctctctccgtctatactggcccctcctattcaaggtgttcaaggttctgttgtaaccttagtaacctataataagtattcctaatagtcatcagtatcaccactgttaacacatttgggcagcaccatgcatggcaggtcagcaaacaggtaaatcttatttttttaaacattacacataatatctaaagtatagtatgtggcatgtaataagtgctgctgaataaatggaagtcattgttcagtttttagcttaatatatctttttttttcttttaacataacatttactgaatgttgctaagtataaggagtaagggacataaaatgaatgagacttggtctctgcccttgagaaactcacagtcgagttaaggactgtgaaatcatgtttaaagttccttagccttttcctttgtgtcatcatttcttcccctgcactgtctatgcatgatatagcctgtccattgtttctcacagctttcctaattctgtgtgcctccccagcctttgagactgctgatatgtgagaaagccaacaattgtcttctattaatacagggtaatatcaagaaaaacctttgggccaatattggatttcagagtggcatgtgcagttgacattacaataccagtttatggtctttagatgggcctgtacacctgggctccagcctctttcctgtgcctttaaactgccttacttccatctttcctcccctataccctacccttaatgtacttggtacataaaaatagaggctcccatacccaggtagtgatcaagtacaatgtaaagaaacagctgtacttcatataaactaggattcgagtgggcctagggtatatcactaaatttccattcttatctataaaacagtaatcggaaagcctatttcataggttgctgtgagcattaaagcgagatgatgtatttttaaatgcttgtaaagtacgaagataaggtcattataatttatataaaatacttagtagctatgttacttggggcaaattacctcatcactgagccagtttcctcatcctttaaatgaagatggtgatattcatttaacaaatatttattgaggacgtagtcattgcagctacatcctgggaatacaaagataagtgactggagaatgtaggacagtgtggtctaggggaaggagacttgcaaatcacacaaaagggtcagtatggtaatatgaggaatgaacaaaatgtgctatagcagtttacaagaaggcatcagagaatgtcacagagttttgttagggttaagcaagataaatgaaaagtacttcatgaattcaaaaatgctatacaaataagttagttaaacgtaccccaaatgaatcaatagtctcaaaccattattgtttcatttcttcacaagacttactctttagatgcatttatttctttgagctagattttatgacctccttaagggtaacctgtagtagagtatcctgaaagttaatgcttttgtctaaaaggatttttttcatccattttatcattttctagtttttaatcactgaattcaggaaaaactagaaaatgtgtgcatatttggggagaggatatacataattccaccacaatgtttagtcactgttaacattttggtgtattcacatcttaatgataagggtagtgtttaaggaataagaaaagaaatctagtaggaaattttaaggataggcatttcccagaataggaaactaaaaacgtccactaacaagaaatggtactcaaactaataatcagaaatgcaaatttaaataaggtcatttttagtcattagattgataaaaaataatttgataatatcaagtcatcgtaaaaggtataaggaagagtctggccttataatactgcctacaagtggcgtaaattgatacagctattttggaggcaattttggcaagttgcaagagagtacatactatgtgatgctatttatgttttaaaaaaaaccatggcaaactgacaactttatttgggaggagggatcatggggaactttacctttttctgtaatatgtgcatttctacttctgaaaaatatactgagaagtacagagaataatacaacaatccctgtccctacccccactccagaattgatcatttttaacatttatttttgccttacatttttttgtggagttggaagtaacacaagttgagtgtccctaatccaaaattcaaaatgccccaaaatgagtttcaacacgatgccacaagtggaaaattctacgcctaagtacttaacactttgtttcatgagcagaattattaaaaatattgtatagggtacaacgaacattatttgggtgatggttacactaaatgtctagacttcactactgcacaatatacccatgtaacagaactgtacttgtgccacctaaatttatacgagaaattgtgtaaaattaccttcaggctgtatgtataaggtgtgtatggaacatgaatggatttcatgtttaaacttgagccgcatcctcaagatgtctcatgatgtataggcagatattcaagaatctgaaatctgaaatcctgctggtcccaagcactggataggagatacttaacctgtataggtaaacaggagatacttttttaatacccagcattcccttccccccttacaatcagtacaatgaattgcttgaatttttctactgtgagaatggtataaattatgaatgtaagtaaaagttcaaaaccgatgtggtggccacacaaaaacctattattaaataatattaaatttgtacagtattttagagtttgtaagaagcattctgattttagtaagaatgctttgggaatagaactttttttcgtttgctcattttcttgttaactcttgtttgaaaacgttttcctgaatttgtttttaagtaatcttcatgactgtagaattatacatggcttattgttgaaaaatacagataaacagacaaatttccgcaaaccccaaactcacagataaaatactcttaacattttggtatgcagtatcttcttcgaaggcttttcttaactgctctgtagccatattatatattttttcagaaatgctctttttaaaatgtaattcattacctcccttccagctttcaattttgtatgaaaaatttcaaacaaaaatgctgaaaacatagcacaatgaacatctgtataccatcagctggatccaacaattaagtatttgccatattagatttatatgtacagatgtgtgtttaatttttctcaacattagaagtaaggatgacactttatccttaaatctttcagctgcatgtcttaagaatgaggacatctcagccgggcgcagtggctcacacctgtaatctgagcactttgggaggccaaggtgggtggatcatttgaggtcaggagttcgagaccagcctggccaacatggtgaaaccctgcctctactaaaaataaaaaaattagctgggtgtggtggcacctgtagtcccagctactcgggaggctgaggcaggagaatcacttgaacccaggaggcggaggttgcagtgagctgagatcacgccactgcattccagcctgggcgacagagtgagactctgtctcaaaaaaaaaaaaaaaagtaaggacatctacaaaaccacaataccattatcacgcctagggagtttattttttcttaatattatctaatatccggttcatattcacattttctcagttgtccccaaactgtctttttttccaagctgttttctccaaactagtgtagaaatggtatttttaactttgctcttcccacatattgacccctgtttcatgtctttgtcattatgtatacttctgtagcatttttaatggctacattgtattctattgtatgcagaatttatttaaccagtttgctttgttcacaccttttgctgtgttcatacttttccctcaggtgtccccaaactgtcttttttcaagctgttttctccaaactagtatagaaatggtattgttaaatttgctcttcccacgtattgacccgttccatgtctctgtcattatgtatacttctgtagctttttttttttttttttttttttttgagacggagtctcgctgtcgcccaggtcggagtgcagtggcgcgatctcggctcactgcaggctccgccccccggggttcacgccattctcctgcctcagccttttgagtagctgggactacaggtgcctgccacctcgcccggctaatttttttttgtatttttagtagagacggggtttcaccgtgttagccaggatggtctcgatctcctgacctcgtgatccgcccgcctcggcctcccaaagtactgggattacaggcgtgagccactgtgcccagcttctgtagcatttttaatggctacattgtattttattgtatgcagaatttatttaaccagtttgctgtgttcacacttttccagtcccagtttctcatgattttaagtaatgcctcctaacatacaggtaattcagcattcagtaaataagtgtcgaatgaaagaagcataggtacatcctaatagataaatatttatgagatccatatttaatatttttaattttttatttccataggtttttggggaacaggtgatatttggttacatgagtaagttccttagtggtgatttgtgagattttggtgcacccatcactggagcagtatacactgaacccaatttatagtcttttatccctcacccctttcccatcctttccccctgagtccccaaagtccattgcgtgacatccatatttatatccttaagaaatttctacaaccggaatgtaaaaatgtaaggcttttaatactcattgctaaattggcctttagaaaggctaaccttgcatttttcactgtgatatgtttagtatatgatccatcatgatttacaatattgtagcacatcaggataagccttgataaatcagaagagtataaatctggatatagccagtatcgttgtagatggctcactgcatatatacacgtatatacatatacgtacgtacacgtatatacatagacatatacatatctgctgccatatttttccaggggctagtttgactcttctactttggagggctttgcagtttgttaacccaatctggagtccaggccccggcttcttacatttctttaaatatcttggtgagaccagccttaaaaggaagtatagtctggagagatgcagacatcactagaagatatccttttacgtagagaattttagatttttgcttttaaaaagtaaagacaggctgcttttatgggtgaattcagatctctccctctagcaaattaccaacagctttaaaagggtagtcttcatgtccaacagaaaagctggatgataccctatatttcctattatccatatcaaactccttattttataggcccagttgtaggagtaataacatatccatggtaacatggctggatagtggtgaaattgagcatcaaacccaggttacctagtccagtattgttttcactatgttttatctctccttaaaactgaactttatttctaaatgtgccatctggtgtcatctgtagaaatacaaagtaagtggtcctcttcctatgagaaagttactccccaaataggggaattttaaagtagaaagtcaacgtgagaaaggcaaaaatccaaagaaagctcagtttctttgcccttttaaccgtagttactactttctgacatgagatcaacttggagctctttcatggaacagttcgatttggccatgtgttttcatgcatttatggatgctataaatcagtagatgagactgaatttcctgcttgtaaaactttttcaaattaaagggctgctttctaagtccatcttattttcccttccttttttcaactgttttaaactataacatgtttgctatttttaaaaagattgaaacaaaataatagtttacaccttttagcattatagttaagtattactgtgttaagtatatacttatgttaagtatttttatactatgttaagctttttatgctgaagtaatggtgtgaagtaggtgtgtacttttattttcatccaaatggttagccagtagctcctgtttttcttcctggcaaagtctatttgatctttaaaaatattcttagcttaaaagtgaattatttgcagaagtgtagttttattttttaaaaacctaggaatttgtggcaagtagaaaactagcatggttacttttagctgtttagtttttgaaaataattcagattgttcatgtttaatatttaacatttgtcttagactgaaggcaaagtactacagatagtgctttaagggatcttagttattgtacttccattttacatcatgttggaagcccagaatgtcataaggtcttaaagccagttggtggctgagaactagagtacctttgcatacttcactttcatttctagcaagcatctttcatgtaatagatatgttttaaagcagtagattgttcagaattgtctggtttatttaagaacatttgaaataactatgtgtcaggctgtgtggagcaccataaaatttactcagacagccatttttttctatatgttgggacacctttgtttttaaaggctttgttttacaactttcttatcagtgaactaatttgagcctcataacaaacctgtgaagttggaattcttttcaacatcctggaaagagtttgctgccaggttgataattgctataaataacttgctcttttaaaccatgcaaaagaatctttgtctccattccttccaaattcatttgaaccagctcaaaacagttgagacccagttaaaatttttgattaagtggcatggcctgcacattatttagtagactgtttaccttttgcagaactgtataatttgagaatgaaactggagcctcccaatctcattgtcatcaaagtagagtttaagttgttggttgtctgcagttatggctaacagtatggagattagtatatactgtatgttctccttcatatgcaggtaatgtgtagaaagattgagaaggccagctcttttgcatatgatcagatttatatatctgtatttctgtcttatcaatctgtagaatacctagcataaggtttctgcctttagattaatctggagccaaaagaaatagaacaaatagcaatacggcttactctttgctgggcacaatcctatgagatagacttgtttattttacagaggtgactggactcagagatgtatggcaacttgtctaagatcacacacctagtaaatggaatttaggcccagatctgtctgtttcccaggcttttccattatgctgttgtcctttacttcatttttacttttcttccagtggtagtcttcagcctctacttttttttttttttttttgagatggagtcttactttgtcactcaggctggagggcagtggcatgatctcgactcactgcaacctccacctcccgagttcaagcgattcttctgcctcggcctcccgagtagctgggactacaggtgtgtgccaccacgcccagctaatttttgtatttttagtagagacggggtttcaccatgttggccaggctggtcttgaactcctgatgtcatgatccacccacctcagcctcccaaagtgctaggattataggggtgagccaccgcgcccggccggggaggtttgatctttagagatgctgcttgtttctctgcaaacccaaggacatgagagaattggagctgaataatgcaaaaggggtggaattctgtttctttggtatctggtaccatctttattgtatttgacagtagtctatcatgtggctttgggaaaaaaataccatatacctgtgtttcataaatgaaagggaaatacaagggaaaacattgtcatggctagatagacagtgtcttaactttctttagggcattggttcctaatgttcttcaggtcatagatccttttaagaagccaatgaaagctgttgaccgtcttctgggaaaaagaccaacatatgtaaaatttcccacagaatttcagggtttttgtagtggtcatccttcagtataggatgaggaattctaaagattcctctacacttgtttttctctatatgtcattaagatgtctaaattgctatgttgtttgttcttgtatttcttagtacaggcgtccccgacttaatgatggttcaacttaggattttttgactttacgatggtgtgaaagcgaaacacatttagtagaaagcatacttgagtacccacataaccattttgttttccactttcagtcgatattaagttacatgagacattgaacatttattataaaacgggctttgtgttagatgattttgcccaactataggctctaatgtaaatattgcaagcatgtttaaggtaggctaggctatgatgtttggtcggttgggtacagtaagtgcatttttgacttagatatttccagtttacaatgggtttactgggatataatcccatcatatgttgaagagcaactgtatatatttttctagacttatttttctacacagtggtcaagggtaagcttggctaactgtgtcacttttgcttaaagatatactctgtattatgcaaatttaatttatcttctgtattgatcttataattggttgtgttttcagcctttgggcatgaggaagttgtaattctctttttttgtgtattgacttcgttgcctttatattacgattgcttctaatctattttatttctgatttttttccttattttctacatttctgtacacctggctatctgagtattcatctcaatgccctgcatatagtatgtttataattgttgaatggaaagatgaaggttaaatgaatctaaattgtttttttcagttcaccaagagtttaatgtgacttggattttttttagttttgttaagcatttactggatagttattcatttattaatctgctattaataaatgacagttcatatgctggtacaggaatgcaaagataaatatgatacagtcccactcttgcagaactcagcaagcatagtggggagactgtcaggtaagtaaagaggtgtgctgattgaggatcaatatgcaggatatagttggggctaaataaagcatgtggggagctgagggaaatattatgtaatatcatagcactggtaagagaggtaagcagggaccaggtcctagaggtcttggatgctggtttaaataaggagtttgtacttgatgtaggtaggttttgagttttagggagattgctctggcaacaatgtggaggatagaatggatggatccagcaggaaaaagtctcactttaaaataacttcaatttatgagacttttcaaaacatatacaaaaatagaaaaaagcataatgaacacccatgtaactgtcacccagcttgaacagtgatcaacacagggctattgttctatttataccccgctcctcccctctatttttattaaagcaagttcctaagtcacagaatggcaaagcatatattgaataataatctaatgccatggctctcaaggctggcctgtgctgccaaatcacctgtacagcttgaaaaaaataatccccacttcagacctactgaattagatagctttgaaatgcctgtgtggtcaggcatttttagttttcaaaataagtctcgggtgaagtaagttatttttaagataattttaaaataacttctgacaaatgaaaatactttcctgaactcattgaatgctgcctgtggcccttctgggtgaaattcacctattcgatacaggcaggcttttcttataaatttttatttattttttgtagagacggaggtctcactctgtggcccaggctggtctcgggaaaactcctggcctcaagtgatcctcccacctcaggcttatcctcccacctcaggcttccaaagtgctgggattacaggcatgcagccagaaactgacaattcttaaggtgtagactaggaatattccagagtaccaatttaaaatgtgtagacaaggagtctgttcctctcctgcttaatttgcttaacttacacttaggcattgctgtttttattttttgttgagaataccaagaagggctccttagcatgctgtcatttcctctgtattggtaaaattgataatctgcaactttggtgagccatgtttggttgcctagttcttctgatgccagtttctctaagtaattgggagtatccgggaaggataactcccagatctgcagcttccccagactgtttgaatagaggatgtggcaggagatgtgttctcagatactattctcacgttcaaagtcaacattggaggtttcagattcctctttcttagtatccctccctgcccatattttccttgcttaagcataactgcagtgcagagaaacacccagagccagcataaactcttaatctgaggtatagtgtgttttcagattttaaatgagagactccttcaaggtatttctgcaaataatttccagatttgtcttgggtgagtaaaggctatttttcagttgctttattatgacactttactgtcagtgcccagtaaaacctaggtcagcagttctcagggcacttgagagtcatgttttatgtggctaaggatagggagactggtgtctgtaggagaggggcgtagcaaggtgggctgtgcatatagacattatgtgcaatgtagagttgtggaacagatttgggtttgaatccacgttttaccacttaataggtatgtggccactctcagtaaactgggcacagtcttcatctccaaggattaaagataatgcacaataggtatagagtaagtgttagctatttttttatgatcataaatgtttttcacaatatttgttgagtggatattaatgtattaatagataatcagaaactagataggatggaaaggcctgacaattatgtggtgtcccctttaacaaatcataatcagtgacacctattcctctataatcaaatagtgaatagcaggctggatttcaagatgcatcttactgcttgttgacatgaagaatgctcagggcagctctcacctgaatttactttcagagactataaggcaaaaggaaatcgttgcaaggcaaaaaataaagtattttgctttgtggtactttggagtttagttttctctaagcattttttgtttaagaactgccgtaatgcttccatgatttctatggggattttaggctcattttgattcatccccactcccgtacttacgtgcaacatctcttacctgctaataatcaaccaaagtgcctcctgtgtgccaagctccaaacaccagaagatgtagggaagaagctcctagagtaggcagcagctaatctaaggcatttgtttagatggtgttcttaatctggtgcatgtcctttggctcaggggccagtgttttcttccttaaggaaaattttaggcctggcacagtggctaacgcctgtaatctcagcactttgggaggctgaggccaggaggattgttttaactcaggacttcgagaccaccctggacaacatggcgaaaaccctgtctgtacaagaaatataaaaattagccaggcgtggtagagtgtgcctgtggtcccagctactctggaggctgaggtgagaggattgcttgagcctgggaggttgaggctgcagtgagccaagatcatgccgctgcactccagcctaggtgacagaatgagaccctgtttctttaaaaaaacaaattacaaaaggaaatctgattataaatggatccatgatttataggaaatttggaaggattagaaaagcatgaagcataaataaaactatgtgttaccctgccagctagaggcaaccattaaaggccaactactaataatgtgtatttcttcccttcccaggtttttttttttttttaactttcccaccctgtggcagacattttctcataaatagggaagtgataggtacagagtacaatgtaatcacatatggtgggatatccagtcaagatttgaggggttcgggagaagattgtccaaattctggatatcattctgttcaaacctgcataagtgcttattatattacagtgaaatagaggctaaatggtcccctacccccaattttcaaagggattcttacagttactccgtcttttcaagacagtttgcagccacttgagaacataagctagtgtctttatttaccttttcctctacatttcagtgaccccataattctctgcttccatttacagcctatatatatattttttcccccgagatggagtttcactcttgttgcccagactggagtgcaatggtgcaatctcggctcactgcaacctccgcctcccgggtttaagcgattctcctgcctcagcctccgaagtagctgggattacagacatgcgccaccacacccggctaatttttttgtatttagtagagacggggtttcaccatgttggtcaggctggtctcaaactcctgaccttgggtgatccacccgcctcggcctcccagagtgctgggattacaggcgtgagctactgcccctggcccaacattttcagaagaggtttttacacataccatttatgctttctcactttccattgattccctgactctagtctggcttccattccctccatcccactgaaacaattgcttgtcaaattgtctctattaccaatttcagtggacatacctcattttgacatttgatgcagttgatcactcttgccatctttcgtctctcgtgatagcataattagctagttttgctctttcctcactagcctctccattgctgggttttccttctttccttacctttacacttttattgtattgtattttttttggtagagatggggtttcaccatgttgcccaggctggtctcgtttaaggaatctgccctcagcctcccaaagtgctaagattataggcttgagccattgtacccggccccttctttgccttacctttaaatgctagagcaaataactcagttgcgggcctcctcctttccttctttgtaagcagtcatctccagacccatggcttcaagtaatatatgtgtgctgacaatcacagattttattcttaatgcatacgtctttcctgaactccattctacaaatatttgcatacctatcatgtggaagataccgtgctaggtactgagagcttaacatcttagaaaatcaaaccagtaattacagttgatacttgttatgaaggaaattggaaataaactgggtgctataatagaaaaattacagtgggaccaacttgaggtgggttgtcatggaaagcctctctgggtcttagtttaaatgtcagttcctcaaatggaactagttgtgggaaaggaggggtggcaaaaacattccagcggcgaacttagaaattagagtgttccaagaactaaatggaaagaataattacacagttgaggaaacaagcatagagaggtggatttgtctgcggttatgcagtgagtaagtgatatagcagggattctagcccaggttttctgagtctgtattctgatctagtgcttctcaaactttgttatatggatcacctaaggatcttgttaaaatgcgggttctgactcctcatatctaggtggggcctgaaattctgcaacttttaataactcccaggtgatgtcagtgctgctgatccttggaccacacttgattagtaaggctagtctttcactacatccaactgctcttgagccagatttgggaactacaggtgtcctgtgcccttaaactgattcagtattgaaagtcattatttttaaatattatcaactggaggtgattactatagaatatgagtcacgctttgagtggcttccctcaggatattttagttgtgtacacttgttctgcaggtaaactgtacaaaaccaagattcaaacctcaggggtgtaaggaaaggttgggggaataaggaagtgaaaaaaaatattagataaaagtattgaagtaatggtaatagatatggatggtgattcatagtaattcacttgttttcttttaagttggctatctttctaacctaagtttaggaagcaatgtttattatatatagagattgcttggtgccctgagttctggttctgacccaacaaaggcagtaggccatttctaggaatttgtttcaaactaacttatttttatggaaggatttttttttaaatgtaatagggttttcacctgattaacttctaagaggtagaactcattccccagttactgttcctttcattagtgaaattacagcatctcagcttctcatcttgggccctagtttcctctcttggagtaattttttcaaacaaataggattcagcagtctagaagaatctgtcacaaatttttattcttatctgccaatattttgtagtaataaaactggttttaaaaaaaggtgaggctgggtgccgtggctcacgcctgtaatcccagcactttgggaagccgaggcgggcggatcacaacgtcaggagatcgagaccatcctggctaacacagtgaaactctgtctctactaaaaatacaaaaaattagctgggtgtggtggcgggcgcctgtagtcccagctactcgggaggctgaggcaggagaatggcgtgaacccgggaggcggagcttgcagtgagccgagattgcgccactgcactccagcctgggcgacagagcaagactccatctcaaaaaaaaaaaaaaaaaagtgaatcgcatgttattaaagcatggacttggtagtcagacctggatttagatcttggtgctaacatttactgaccaagaaaggtactttttttctctcttacttcagttttctatctgtaaatagaggcaaaacttgacttgagtggtgaggactgtatgaaaaaatatcatatgaattccctaggtagcatgtctcaaactgtattctttggaatacttcaattggactttgagtagatgccacttgagaaaatggttctgtgcgctaataagcctcctttacctaagatgtcttagagccattaataatgtcaattagctatgtgactgccctagtggaagagaaattctgtctataacatttcccaaattacaggattcttgtctccctttatagagcaagacattctaacacactttggggaactccagtctcagtattgtctggcttgtaatggacactcagtatactaacgttcccccctcccactgttgaaaccagttttagaaatatgagaacacaacaacttctaaatttttaaagttgatgtctcatggacagtgatgtcttggttttttaaactacaaatgtttcttgcagtagaattatagacaccaaggtaggactgcacttgttatgggaacatttgtgtgtgtgcattcatattggctctgttattttattgggtgcatcaaatgcttacacttgggacttagagtctagcgccactcatgcaaataacctgagatgatttagaattatgccaccagcatagtttctaggcatccagagtcttgtgttggcagcagaagtaccccaagctaagctgtttccgtggggggtctggctgtagttccaggctccctagcttccttggttcctcttagttttctgcacgtggagctctagccttctgtcagttctgtgagctatcagatactctccagtaaattacttggctgcattaattatccagtctttctgtagttacagacacttgactagtatagtacactaggtcaaaacagcattagagcaagttgcttatttgtttgaagattcatcagtgactcatctgcattaaaaaagtaaaatggttgtgatttgcttatttcagtgcataagttactctgtgctcttgttttggaggattgtttttttaaaatagactttatttttagagtagttttacattcccagcaaaatcgagcagaaggtacagaaatttcccatatactgcctgcctccacacaggcatagcctcccttgttatcaacatctcccactagagtggtacacttgttacaattgattaatctacattgatacatcattatcactcaaaggccatagttaacattagggtttactcatggtgtatacttttggggtttagacacataataacatgtgtccaccattgtagtatcatacagagtagtttcactggccaaaaaatcctctgcgctccacctcttcattcttccctccccactaaccctcctcaaccactgatctttttactgtctctatagttttttcttttctagaatgtcatgtggttggaatcatacagtatgtagcctttttgtactgatttctttcacttactaatatgcatttaggtttcctccatgtttgttcatggcttgatagctcgtttctttttagtactgaataatactccattgtctggatgtaccacagtttatccattcacctaccaaaggacattgtggtttcttccaagttttgacaatagtgaatgaaggtactataaacatccatgtgcaggtttttgtgtggacataagttttcaactcctttgggtaaataccagggagtattgattgctgggtcatgtggtaagagtagttttgtaagaaattgctgaactgacttccaaagtggctgtactattttgcattcccaccagcaatgaatgaatgttccacttgctccacatcctcacaagcatttggtgttgtcagtgttctgggttttggccgtagtgatatatcatcatggttttaatttgcatttccatgatgccgtatgatgtggagtatcttttcatatgtttatttgccatctgtctgtctgtggtgaggtgtatgttaaggtctttggcccattggcccatttttaaatcagcttgttttcttactgttgagttttaagagttctttgtgtatcttgggtaacagtcctttgtatgtcttttgcaaatattttctgtcagtctggcttgtccacttattcttttgacagtgtcttttacagagcagaatattttacatttaggtctgtgatccattttgacttaatttttgtgaaacatgtaatttcggtttagattttttttttcgcatgtatgtatcgagttgttccagcaccatttgttgaaaaaactatcttttgtccattatattgactttgcttctttgtcaaagatcatcggttgacaatatttatgtgggtctacttctgggctccctaattctgttccattgatttgttcattcttttaccggtacagtactcttacttactgttgtcttatgataagacttgattttgggtaatgtaggtcttctgactttgttcttctcctttgatattgtgttggctatcgtggatcttttgcctcttcatataaattttagaatcagtttgtcagtattcatataacttgttgaaattttaattggagttgcattgaatctgtggagttggaaatgacttaacattttggcagtattgaatcttcctatccatggacttggaatatctctccatttaattgttctttgatttctttcatcagaattttatagtcttccttgtatagaccttatacatattttgttagatttatatctaagtttttcagttttggggtgctaatataaatgttttttatttcaaattctgcttgttcgttgctggtatataggaaagcaattgactttttttttttttttttttttttgagacggagtcttgctttgtcgccccaggctggagtgcagtggcgccatctcagctcactgcaagctcagcctcccaggctcatgccattctcctgcctcagcctcccgagtagttgggactacaggcgcccgccaccacgcctggctaattttttgtgtttttagtagagacggggtttcaccgtgttagccaggatggtctcgatctcctgaccttgtgatccgcccgcctcagcctcccaaagtgctgggattgcagacctgagccaccgtgcctggccagcaattgacttttgtatattaaccttatatcctgcaaacttggtgcaattgcttgttagttccagggtgtttttccttatttcagattttctgcatgtatgatcatgtcatctctgacaaaaagacagttctgtatcttccttcccaatctttataatttttatttcctttactgctttagctaggactttcaatacagtgttggaaagcagtggtaagagaggacatctttttcttttttgagacggagtctcactctgtcgcccaggctggaatgcagtggcgcgatctcagctcactgcgatctctgcctcctggattcaagcaattctcctgcctcagcctcctgagtagctgggattaaggggttttgccatgttggccaggctggtcttgaactccttacctcaaatgatctgcccacctaggcctcccaaagtgttgggattacaggcatgagccactgcgcctggccttttttgtttgtgattatttaagggggaatgctcctagttcctgaccattaagatattagttgtagctttttttgtagatattttaatcaatttgaagaagttctctattcctagtttactgagattgtttgacttttcactgttgaattttgagagttctttatgtattttagatactatatatggtttgcaaatattttctcctagtaaattttattgtcctatatttaagtgattcattttgagttaattttttatataaagtgtgaggcttaggtcgaagttcatcttttttgcctgtgcatgtctgctttctctggcaccatttgttgataaaactatctttccttgactgaattgtttttttttttaacctttgtcaaaaatcagttgggcatatttgtatgagtctatttctgggttctctattctgctctattgatacttgtatatatatcagtactacttgatgtctgtagctatatagtaagtcttaaaagtgggtagggtaattcaattcctccctcttttatttttttccaaaattgtttcagccattgttgttcttatacaacatatacactttagaataatctcagcttatttacaaaaaaacatcttgctgggatttgaataggaattatattaaacctatataacaattttaggagatttgacatctttactagagtcttagatctctccatgtatttagagctttgatttttttttttttttttttttttttgagactggagtctcgctctgtcacccaggctggagtgcagtggcactatctcggctcactgcaagctctgcctcccgggttcatgccattctcctgcctcagcctcctgagtagctgggactacaggtgctcgccaccacgcctggctaatttatttttttttattttgagatggagtctcgctctgtcgccaggctggagtgcaacggtacaatctaggctcactgcaacctccgcctcctagtttcaagcaattcttctgcctcagcctcccaagtagctgggattacaggcttgtccttccacgcccggctactttttttgtatttttagtagagacggggttttaccgtgttagccaggatggtctccatctcctgacctcatgatccgcccgcctcagcctcccaaagtgctgggattacaggtgtgagccactgcgcctgcctggcctttgtttttttaagatggagtctcgctctgttgcccaggctggagtgcagtgagccactgcgcccatcctctgggaggcttttaaaatagatttcttgggttttctatgtggatgatcctttgacatctgcaaatagggaccatttttattttttcttttcttatctgtgtgcctgttatttctttttcttactgtattatattggctagaactttcagcagtatgttgaataaaagtcatgataacagacatctttgccttgttcctaatcttagagggaaagcatcagttatttgagttgtattgaggctggctgctacgtcttgcagcaggggcagtttaatagcctccctgcaaatgactgaagcgacaatagtgtgacagccacttgcgtaagacgtttatgagaaaaggggaggaaaaaagccttgagagtaagcgtacaaatagctcagcttatagtttccaccacatggacaggattgttgccagaatcctgttggcttcatttgagatattttgaggttgttggcatcaggcattttgttcattttgtattgatactgagataactttttaaaaagtaatctggaattacacaccctaaatatcaaccatagaaaacattttttcttcttaaggaatggtctctgcagaaatgttttagaacgtattctgaatttttcacaaactcttccttgaatgcctgctgattgaatggatacaggtcgtacaggcaaatacacgctatttccatagtactgagtatattggactaaatctaggcaaaaagctgcctaaaatttatactgtaattggtcagctttatattatggcagccttctcgggggaggaacattgatttctagtgactgccactgagttaaatacattgttaatagcagaatcttttgtgtgtaaagagcctgcaacccacttctacctctgtgcatgtgtcttagttgctaacaggagaaacttatttcttcttgtgctttggaggacttgtctgccatcaaagatctagggattatacagtggatctgatcaggctgttgtctgcttttgagccttccaaattacatggcttaataaaatgattgttttctgtgctcagaatatttctgttgtgatccttatacttcattttctagttgaaaaaagtgttgttttgcctttgctcttatgatacaactaatacatttttattggtaggaacagtaaaaggtgcataggtaaaacagtcatacttaatccttttggttaacaatgaattaatattctgatgcctagcacctctaagctgttttctttagacataagttttataccgtatgttctgtgttgtaatctttttatttcatcatgaacatctttgtgtattacatagtttgcaatatttttaacagttgtgtgacattccattttaaaccagtcgtattttggacatttgatcttttttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttattttcaattaagagtttgagatgcttgtaaaagagaaaaaattttcattttgacctgatttggtttcagtcttgtgcaacatagggatgtgggccagtttgatctggagagattctttacctctctctacctgatagctgtgcctctgagttggcatagcatcataactccagtgtttttactttaagcattttgcattgctcttcattctgtattgtctgtgtccaagcttgtagagctcaagattgtagctttaagttctcacttcttttgggattttcttttttcagatcgtaaagctgaaaattgaaatcatgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctagaaacagtaagattttcttttgaacttccctggatcaaaaaaatggatagccaagagaccagtggaaagtgaacaccgatcagttagttcttcgtagctgtgtgtgcctgaagtcagctctcaggctgctgtgcaattccttcctatgcagaaaggatgtgtggtataatggaaagagcagatatgggttcagatttttaatgtacttctgggatcttgcaattttgttttttagaaaatgaaagtggtaacatctttcttactagtttttttgttaaggccagtgttttagcttgtctttattactgattcttaatcacacaattcagcttaacttgtgtattgggtggtcatatcaattaaccctttgtcgacagtagaaatcccagctttaatctagtaatattccaccagctagcttgaactgctttctaaggttgaggaagtggtattgcattgtgatagtcctgttgaccccttgtgcttagttcagagagcacaagctttgaaattagacctaggtttgaatcttaccagacttttgtggctgagaggttattaacttgcctggtttccacagctgcaaaatggggctgaaaattttttccttcttgatgtgaggcaattgcttagcatagtatctggcacataagttagttcatatcgtaaatacaagccacttggttttcaaaaaatgtaaaagtacctggcaagtatcaccaaaagataacaataacattttgctgcatttcttccagttttttttgtttgtttgtttgttttgagacagggttttgctctgtcacacaggctggagtgcagtggcacgatcacagctcactgcagccttgacctcccagctcaagcgatgctcccacctcagcttcctgagtagctgggaccataggtgcatgccaccatgcctggctaattttttattttgtgtagagacaggatcttgccttgttgcccaggcttcttccagtcttttaaaaaattattacatgtgcacacacaattatcctgcccttttcatttagcattgtactaatgagtatgagcagcactttcttcatatacccttgtcagtattacagattgtcttttaaatttttgttaatttcataagtggggaagaaagtatttcactgttctatatcagttatcttcttgtgccattcattttgtatctgacattggaatatcagtgtttctcttactgaatgccatatatattgaacgtactcattttcatatctgttggaaatatcttcatttgcttttgattttgtttttgatgtgttttggcatctagaagttttgacaactgtgtacttgaatgtcttttactgaaggacaaaaagaaaacttgcttaagaaactataatttaaaaatttaaagtggaaccaatgtaagaatctactgctacgagaatagaagacctagaaaagtgatcctagtgtatataagaactagatatatggtaatagagggattataaattggaaagaagggacagtattaggaaaccatgctagaatgattatcttgtagagcatgtgggactattatattgcgataaattttagataaaccaaaagtcaaatgtttttaaaagaaataagctataggagaagtagaacatgtaggtgaatgtttactttgtcttaagtgggcatggtctttccaagcattaaaacaaaggaaaaaaaccataatggaaatgttaaatactgtatccaaaattaaaaagacatgacaatagccatcctaataggtgtgaagtaatatctcattgtggttttgatttgcattcccttgatttccttgatagggagcacctttttatatattttaaaactatttgtatgtaaatagacatctggataaatgtctattcaagacccttgcccgtttttaaattgtgttatttgggatttttttgctattgagttgcaggagttccttatatattttggaaattaatccctggaagacattaggcaaagtgaaataagtcagccgcagagggacaaatagtgcatgaatcctcttatatgaggcatctaaaatagtcaaaggtgtaaaggtaggcagtagaatgatagttaccaggaaatggtgggagagagaagggggagttgctgctcagtgggtataaaattataccaggcaagttcgttccagagatctgctgtagaacaacatagtgcctatagttaacagtcaggtattgagtatagtctgccctccgtgtgtgggttccacatttgcagatggaaccaactggatagtaaatatttgggggaaaaaacaataaaaaagaacaatacaaaagtaaaaatagaaattttgaagcaatgcagtgtaacagctatttacatcgaattcagtattgtaatactagagatggtttaaagtatataggaggatgtgtataggttatatacaaataccattgccattttatacaaaggatgagcagcatagattttggtattcatgggggtcctagaatcaatccccagtggatacagagggactactctacttaaaaatttgttacgagggtagatctcacgttaagtattcttaccacacacaatcatgcacacacacgtagggacacaaggaaacttggaggtgatggatatgtttattacctggattgtggtgatggcaacgtgagtgtatacatacatccaaactcacccagttgtatgcatgaattacgtgcagtttttttgtataccatttaccccttaataagctcaggtggggtgggggagggggaagacacatgacaagctggggaaaatatttgtaacccagtgtagttaatattttcagtagctaaatcaggagaaatgaatatcccaatgacaaaatgggcatagggcatttaagaaaagaacaaacccagtaaacgtccagcaagattcaacttagcgggtaattggagaaatgcaaattaaaaaacaatttttaacctagtggattgtaaggggttgctcttggagtcatatactgatttctggctcttatttcctagttactagcaagttacttagcataaactcctagaagtggaatttttatgtcactggttatggacatttttaagacttgagttgtctattttccttgagcagcatacatgattgcccccatttcccatactgtggtcaatgctaggtactattatgaaaggcttttattgatcactttgtgtatcagtagctgtgcaaaggattttttccccagatttggtatctattgaaataaatcactgtaaaccctggcaattgttattgagctatcgaactggcaaatgctttcttatatcttaacgttgtgcttgctgctttctcctgcaaaatgcaagggaccttgatagtctgataaaacagagaccatagtactggtacattaaattgatgccattatgctaactggatcttgtgagcagaaaacacaagcacaccttagatgcctcagacatatttgtgccagagagtcagaaacaaaccttgtggaagcttgagggccttttcacattaggaaagtttctagtggccccagggtttgggaaatattgggatatcccttctaaagtgagagggaagttgctgtaccttgtaccacacactgtgaagaaagaggaacaatgtgtgatgcgtttggattttggagccaacatattggttggtcacatttaggcatgctattttgacctatttactggataacctctaacacatttagtggggaaccactaaagtgttagtaaggtttggatctagaaaagactctgcaaaaggtccaggctatgatacaagttgccctatcacttggacattatgacctagtagacccaggtgactgacttaggtgtcagctaaagatgccatgttgtgcttttggcaagccccaatagaattacaagtaagacccctagattcttggctgtgctgtcctctgccaccagctattctacattcacaaaagcagcttctggcttgctactgggccttggtaaagactgaatgcctggttatgggacataccaaattattacaggatccaaatgttcatcatgaactgcatcttacctacacatcgtaaaattggatttgtacagctgcattccattagaaatagaagtaacacgtttgatgctggacccaagtaggtccagcaggcacaagtgaactgcataagcaggtggttcaaatttccatgttatctatttctgctgcttcactgcctctccctcaacttacatcttagaggagaagaggaaaaagtgcaggcctggtttatggaaggattttgtgccaaggattttacatatatttaattaccatgaacatttgaggtagatcttaataatgcttagagggagaaaaggtttggacttagcttaaagaaacccctgttaggttccatgttgtttcagatgccgaaaatacgtttctcccagtttgaatctcacgacagcattgctggatatataggtacatgttagtttattttgcagaagaggatgctgagattcaaagaggtagcttaccaactacctgattccaagggtcatactctttttaatagtatgctgtctctgaatatttaagctcctgtaatgggagataagtattttatgtatgtggcagacgtttgagtttcatatttgtgaggtagctattaggtctgtttttctgataagagagctgtggcttagaggttagacttgctcatgatcaaacagcttagtaaacatgaagttaaaaagtgaatccagacttgtttggttccagacctctggtccattcccaggatgctgtactgcctttatggagttaaagaacaagtgtaataatcacttctcccagctgccattcattaacggaaggcttctctctcccagcccctatccctttccctccttccactttcagaaacttgactataaatgctcaatccactccttgttacctgacaaatggacccattcatcagtagaagagagcagaaatgtatggaaataggaaccccaagaaagaatggagtcctagttttacgaagttcggaagctgtttaccatcttacaagtgaaggattttatgtaacagaaaaatatagctagtgctaatcttcacctttaattgtgaattcactaggacttttcagtctctgattcaatataacctaccaggcattctggttaactttcagaccatggtatagattccttaattgtttttttttttttttttagatgtttaacttattattgtttttgttgtcagcacctttccaaatagtttgtctgcatctacctttatccaaatccaaggtgggtttttgttttgttttttgtttttttttgtttttttttgttttttaagcccaggtggattgttgggggaataaaagcattttctcatgaggtttccattttaatcccaagagattgtctggcacatctcgttttcttaagtagtaaatcctagcaaaaggaaaattgctgtgtgagcttaagggttccttttctgattctccttatttgcaactccctcattccaaaacatcttttgtgaatacttttcttttctcagcctgcagactgcagagccttaatagacaaactcaaagtttgtaatgatgagcaacttctcttggaactgcagcagatcaaaacatggaacattggaaaggtatgtgaagtcaagctcccaaaagacaggactcaccatactaatacatcattttgtatgctctgatatggaataagaaaccacaatgggatagcctcattcagcaattaataagcatctagcatgtgccatgtgcctaacacagctttaaaccagtggcaaggaaaattttgctggctgaggatggagaattgatttcacaggtgatgcttaagaatctcaatcacagaattcctgtggtttgacaatataagtttgagataatttctggatttttagtttagaagaatttttattagataactctaaaaatgaatttttctgataaaatggattctggcaaggatagttctcttgtcttcgtagatcttagaatgtaaccggagttctccatctaaagacctagctctaggggttttatggtgtctattggtgttagcacatatatctagatgggtatgacaatgaactacagcacttttagctcagagtatgatctttctcatatgggcaagggtgggacgtgaacttgtctaggtgtcatgctcagcaatctcttgtaacaaagctcagttagaaagcacccatgcggcgcttctaccttattcttacatcctctttttcctcccctctccagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagaggtaggggaggttaaagcctgtgtaccctgttcttgactagaattgtgtacatccagaaataaggaaattgctatttctattgcttctttccttttcattgtggagctctgggtttttcattgtcaaagataatagtagaatgtttcttggatatagatactatccttcatagggttgatgggaagattctgtactatcacctttgctttgccttttcaagattcaagaaatgaatgagaaatgttatatatgtattaaagtatttaaggaaatttgcatgaattgatttttgccctaggttgttagagcagccccacattacttttaaattcctagaaatagtttgattttctcatcacattaatgtacttactactcctctaagtgttagtgtgctgctttaaagtctctctgtactctgccacacccatcccaaaatatatattcatagcatcctttgtgtccttgaagagtaaggtaggtgcagcaatcagtgagctttttaattggttaaaaatcactgtaagaagaaattattttctttttatagaagcccaactttagactttttatcatcattagttaggtgccctgttaattttaggtgtgttttcctacgtcttcagtagagaaacagaatcagaacaaacaacttaaaagaaaatggcttaggaaaagaagtgggataactgaactaaaggcctaacatacagagctttaagtgggaggtaaataggcagtctgttgaagatgaaatagatatgctgcccatggaagtccatgaccttcggtataattggcaactggaaatgccttggttcatttctagctatattacatactgattttaattctgaccaactgcttcaatgtattggtgaattttaattgtatttaaaagccaaagtaaggccaggtgcagtggctcatgtctgtaatcctgacactttgggaggttgaggcgggaagatcacttgagcccaggggttcaagaccagtctgggcaacatagtgagaccccatcgctacaaaaaatacaaaaattagcggggcgtggtggtgcgtgcctgtagtcctagctactcgggagacttcggtgagaggattgcttgaacccaggaggtcaaggctgcagggagctatgatcatgcctttgcactccagcctgggcaacagagagaccccgtctccaaacagcaacaacaacaaaatccagagtagtcactcaggttccttatgagcatatactgtactgtaacacttatatgttatataattgccacgagctgttatcgatatctttagcttctatatgaaggaccctgttttaattaatttcaattttatgtttgtcataaaggatacagaagagaacataaaatatctttctttcacaatacttttagtccagttagagacttaatgttcttcttgagtcccacatgtgtatttgtctcttttccttcctgtgggaaaacctgcgcaattttgaaccactatttacgttttttacttttattgcactttatagctaactgccagattttaagctccttggggataaggttgcatgttgtagattatcaaatacatatatatatatatatatatatatatatattttttttttttttttttctttttttgagacagagtctccctctgttgcccaggctggagtgcagtggcgtgatctcggctcactgcaagctccgcctcccgggttcacaccattctcctgcctcagcctcccgagtacaaatacttatatattttttgtattgttgtgactaaacttcttgatagctttgtaaatgttgacaagtacattttgttttgttttcaaggccagttgtgcctgataccttgagctttgcccttttttgtccctttagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagaggtgagtcttgggtgaagagttggaggggtgcaaaaattggagcatatggttcctttcaacaggtgtttcttggagtgttaaaatatattagaatccctaagttaacttcactggcctaattgagttagaactattggtgccctgttttaaaacctaagtattctcagttattaagtaattttgaaggaattctttaatctctgctcaccaaacaaaatctctctgttcaaaagtggcaatttcacttctgaaaggaaagttcaaaattagattcaattctgtgtgagaaggaagtataatgcaataataagatctagatttgagtcctggccctgcttactagcgccgacactggtttcctcttctgggaatttaacatatctacttcagggttgatttagaatgaaatgaattgtggggtactcagtgctgtgatcagtaagtcgtagtgattgtaattgaagccagaagctctcatataaaagttcagctctaccaaactattgtccagtgttcccagaggcaacttcttaatacatacttagctttgagaggtaacccactgttggaaagctttcttagaagaaaagtgttatggctggctttttaaaagcatatttaatgcttacctcaaagtaattcaagttttcaggctaattcaggtgccatgattacttataaattagttttgtataattataaatataacatgtattctgaaaattctaggaaaatgtagacaaaatgtcaatcacctataattcatccctatgagacctcccttaaagttggagcatttttttcttgcatttggaaacacatgtatacatgcatgtgacctgttttcttaagatactgtaaatatttcctcttactattaaaaaccacaaggaggtttaacattggattcccaagtccacagttaaaaggaaaaaggaactattactcaatagatgcttccaaagcactcgataaaatttatctcattaacaaaagcttcatataaactttaagaaaactagagttacctaccagaagtcataatgggggagctgaggcatttccattggattcaaaagtcacacaaaaatgtcagacattaacttctgtcatttacatttgtagtacagatgctaaccaacagaaaagaaagaagcgaagaatacatattaaaagaaaaaatttgggctgggcatgatggcttatgcctgttattactggcacttggggaggctgaggcaggcaaatcgcttgagcccaggagtttgagaccagcctgggcaacatggcgaaatcccgtctctgcaaaaagtacaaaaatccgccaggtgtggtggcacacccctgtggtcccagttacttgggaggctgaggtaagaggatcacttgagcctgggaggtgaaggctgcaatgagccaggatcgtgctactgcattctagcctgggcaacagagtgagaccgagactctgtctctaaaaaagaaaagagaatatttgttactatttgtatgtaggtgatgagtctctttgtttcttggggagataatgtaaaattattataactagtaaaagcacagtgaggtagccaagagatcaatatacagaaacagatagctcttccatgtattaatagcaaccaattagaaaatgattggtgaggccaggcgtggtggctcacgcctgtaatcccaacactttggggggccgaggcaggcagatcacctgaggtcaggagtttgagaccagcccggccaacatggtgaaaccccatctctactaaaacaatacaaaaattagctggacgtggtggtgggcacttgtaatcctagctactcaggacggtaaggcaggagaatcgcttgaacccgggaggcggaagctgcagtgagcctagattgtgccactgcattccaggctgtgtgacaagagcaagactctatctcaaaaaaaaaaagaaaatgattggtgaaaagaccccattcacagtataagcaaatattctgtctgtaaaataagtcatattggctaaaactgtaaatttaagagcagttaatgtaggaggttgtgttgtaataacaatggtggggaaagaattcttaaaatccccatggcataaacctgaaagtaaaattttgaatattgtatttaaaaatatacttcccaacaaaaaacacatagctccaggctactccttaggcccttacactagaatataaatcaacacactgcttccttcatcaagaaaaatgtcagttgtactaaatagtatagttaccaatgtagttaaataacattctggtacaacctcattttgtcatggaccaataaaacttgcaaacaattggtgtaatagcaagcagctggtctgcatacaaaattaggcagcactttgtacaacagaagttaacagacccatggtagattaaaaatgtttaacagtgttttaaaactgaaaagggactgctaatgtagaatatccaaggaactcttccagatcaacaaggatgagcaaaggatatggataggcaatttatagaacaggaaattcatgtgagtagatgcccatactcagtaattagagaaataaaaataaaacaaggtacagctttgtaagcatcagatttgcagaaattagaaaactatataatggtaagtcctggcaggtatgtgaagcaatgggaaccctcatacattgttcataggagtgtagactggttctcatgggtatatatttcaaaggtgagatcgcatcatttccataaacgtgatctctgtcagagtattgcatcatcatttgtggtagtgaggagttggaagcaaccttggtatccatcattagtagatactcaaataagtaaaatgtggcacatgcacactatggagtatgtagcagttagaaacagtggaccaaataatacagcaacattgatggcttctaaacatagtggttagtgcataaaaaagtaaaagcaacagttttcattgctcagtaccatttctgaaacttaaaaagatgtacacaatgcaacatatagtttcaagaaagaaaaattaacagacatcaaaagttatacctttgatagaagggaatctgaatgggcaataatgggacagatacatgaacaagtacagtagtctccccttatccgaggtttcgattgccatggtttcagttacttgcagtataatacaataagatatattaagagagaagccacattcacataacttgtattatagtatatattaaactttatcatcagtatgtatgtatagggaaaaaatgtgtgtgtgtgtgggtgtattatatagggtttgccactacctgtattttcgggtatccactaggggtcttggaatgtatccctatggataagggaaaataaatcttaccagcagtatttaagatctgttagaccaacactaaacctttacttacagatttaaaagatggtctaaatagagacaagtaacattttttaaatgggaagacttaatgtagtagaagccctttaatgaaattaggaccaatgattggtagtttaattattttaaaaatcttgttaaagcaggaaatgtttaaaaagtgattgatacatatgattttttaaaaactaaaataattccctttcccatcttatgtgggccataagacttagtaagaagcagtctgttttctgacataaactacaactataatctgtgattactttatggtgttgcaccgattgaagaaaaggagcctgcatacaggattctaaattttttagagtttacccctgaatctcttcataatttgacactttttattttagcatcttgccttttagatgaatattttgcaaaatattcgacttagtttttgtgaaataattccctttctcatttaaatcagtcaaattgattaagtggaagtctgttaatagcatcaactgagacacagaaataaatgagaaaacactgataatgaatcagggtgagttgctgtatcagataatatcataaagctatagtggttttattataaagccaagtttttatcataaggctttttatgattaagccaagtcttgcagttggcacaggaatagacaatacatctgcaaaatgaaagagtataccttatgttgcttagaacagtgggacagtaggctgttttgaggggaaaatgtgtttagaacttttcttcacacttgacataaatcctaggaacgtatttagaggtaaatacaggtgacttttaagatctttgataagagtttgctaagaaagttaacagacctagaagtcattaaaaatacagctttgatcatgttaatttggttatttgtataggaccacaatagcatctgacagaattcacatcaccctacttttaggctgatacaaacacactaatatttcatactttaattaaatgttctgacaatttaagtagaagttaaaatgcaaactgtttttggtataagtggctcacatatataaagtatcgggtatgtttctttgttttgttttttaggtaattcagatccagttgttgttcttcctttggatgattttaccacagaaaggactgcttaaatgattgcttttttgtccctttgcatttttgacactttttacctttgagaggcttgctactttttgctctgaattgatctaaagagattgtagattggaggttaatttctagtcctggagaatttggaatcttgacaggtgcagtacattgcagcctttggtaatagattgatgtgtttggtgctttgcaataaaagatttttacaggtttttgaggtttagagataattaggtatttagtaatggtacctccaatactaatatccctcattaaaatttaaaaatttcatgtttctctaaaatgtaaaatttctctaaaaacttgacttgttcatgtgggcttcttttatttatgtatttattttttttgagacagagtctcactccattacccaggctggagtgcagttgcacgatatcagctcactgcatcctccgcttcccaggctcaattgatcctcccacctcagcctccctagtagctgagactacaggcatgcaccaccacacccggctaattttttatattttttgtagagatggggtttcgccatgttgcccatgctggtctccaactcctgagctcaggcgatccactcgccttggcctcccaaagtgctgggattacaggcgtgagccactgcctgtccttgtgggcttctttaacaatgctcatagaaatcttggttcatgtcttttcagtcttttcaggcaacttcctttgcaacaaacacattcacttgcatgtgtataagaacctggatttggatgtgaaacctacttttgccaacaaatattaacctgtttctgtgtctgtaaattgggggttacaatatctacctcatagtttttttaggatcagagtaaaggaagtcataaataaaacctgtagggttaatgccatcatgttggaagtacttaataaacagctgtcatttgtagatggatgtcaaccagagaaactacatgccattcttttgtatttgctttcttttaaaatgttacacatgcattattttataagtgcatgcatattgtcacatgattattttcagtacagccttttccctcttggttcacctccccataacctcaaatgtattcttctctatatattatcttcatattatattgactgttgagggtgtttttgtccttcagttacaaatgcaggataccttacatccttgttttcttatttcagaccttgttcaaaaatcactttaaagtcacctgtataactatagggttcttttgatggctgcatagtattccatgctttggatgtaccatattttactcaagttccctattgatgcatacttatatttgttatgaatgatgctacattaagcaatcttatatatgaatttagttactgatacatttaatatgatattataagagatgatatggagatcataagatagagtcccagaaatctcagtgtgactttattggcacttcactgatcagtaatgattttgagcatctttatgcttggccattaggatttgttcttgtgaaaggttttatcttttgtccatttttccatttggttactttttcctactctgtaaaaccatattggagatattagtcctttgtcatcttaaaagtattttttcccctaatcttcatgtatattgtctttgtttattgtgttttgtatgtgatgttttcaaaaatggttcagtcaatgcttttatataaaagattgaatatcgtgttttggtctttatgaaaagtgactttggatatggtgtctttcctcatagtagtttttaatgactaggtcaacccagtgatgtgggctaattgtgaatgtgaacagtgattagttaactacagatgtagggaaaattctccagaaagacttgttgaatcagttgaaagccagttggctggcttttgtgaaggtctggtatactctaggtctagtaaacttgaggatgcatcagaatcactttattaaaaaatatattagtcttcctcacctccatcccacctaactcctgagttgctgattcattaggcttggagtgggcctcagaatttgcattgctataaagttcccaggtaatattaatactaacctgctggtccagggagaaccactggcctagtctattttattaagttacaaacttttatcaaattcttataattccatcttagagagcatcaagcctttttcctgatgtctgaatatttagcaaatcctgtctagtgtgaggtagtgttgtatatgcctctgtggcataatgaatatagttatttatgggttatctacttaagggctaggatgttacagtaacactaccagataggtgaatactgtgaggctcagaagttacttatgtattttttttttgttttttgtttttttgagacggagtctcgctctgtcccccaggctggagtgcagtggcgcgatcttggctcactgccagctccacctcctgggttcatgccattctcctgtctcagcctcccaagtagctgggactacaggcgcccgtcaccatgcccggctaatttttttgtatttttagtggagatggggtttcaccattatttttggacaaaggccctgggctctttgcttctgctaaaatgtgaagaataatatctgttcttcctgtcttaggcatttggggattctttgagcatggtcatgttcgtttttttaaataaaaacaagcttacttagtacttgagaaagcaagataaatagataataaattaataataataagggcaaagaactagtgttattctgaatagtactgactaaaaagtaccctagaatcttaacatttaatatgttgattttgttggcagcgaaacaaacttgtcttcctgataaaaataggtgcttggtgttttatgtatgcaacaaaatttatcataattgtgtatctactcattttggtatattttcttagtctttatctgatgaatatttcttcacaagaaacatttctttatatttcatataatgttactagttcataaatataacaacagcacagactttcgtgagtcacgtttgagttggcagggttttttaaggatctcagcttaccaaaactttctaattaaaggtgcttgttttttatcaagttgcaaaagttggcaagaaggattttgtggtgacactaataaaagtattctgaaacaattagttggaataacagaagaaacaaaaggaaaataattgtgtagatacacagcctttcaagcttattctgccttgcagattcagacttttggtttgacttacctgtctgttctctgtagcatcaagcctttataccctcatccttactttatggttttcagcaaattgcatgtgtcttcgtcttcactagatgtcctgggaagagccaagaaaatattgaaaatgtaatgaagtacttattaggtattaaaccattttataaagctatagtaatttaaatagtgtggtaattaagagtggaattgaccaatcagtaggttccagaagcagatccaatgtgtaagaatcgaatttatggttaagatggcatttcagattagcagaaaaagaatggattattcaaataagatggtgttgtaaaaactggcttactctttgggaggcaattaaggtagattctacctcatcaaagtaaaattaagatgtaataaaaagctgaaatgttaaaaacatgaagttatacaagcattgaaagaaagtataactgcatggttgtatgctgcttgaagtggcaagatattttcaagaatgagactaatgccatgaaagaagaaattgattccattacagtatgattttataccttctgtctgtgaatattttaggtactgtcaattgtgccatctatggttatctcaatttacttcacagttttcttcttacttaggtaatttccagtatttttctgtggtaaataatgctacagtgaatatctttaatacgtgactatttggccatatttagcaccaggtgtttgttaccttttttggggtctcactctgttgcccaggctggagtgcagtggtgcaatttcagctcactgcaacctctgcctcccgggttcaggccatcctcccacctcagcctccctagtagctgggaccacaggcatgcaccacatgcctggctaattttgtatttttagtagagacggggtttcaccatgttgggcaagctggtgtcgaactcctgacctcaggtgatctgcccgcctcgggctcccactggctgagtgctgggattacaggcatgagccaccgcacctggccgtctgttaaacatcttaatgaatgtcgaaccttgtattttacagattcttgtctcattgccttaaacttccctagttgttttaaacttctgattattttttagagttctgatagacttgaattccgacagtcagtttattcactgtttttgtgaaggtgtgggcttatggggttccccattctgccattttcactgacagcattcctagtagaacagtctgtttttaaccagctgggagtgggggatatacatatctgtgtccaggcagactttctcacttaggttttcactagagaagtaagccctaatgccctaaggtatccattattaatgtagcaaagagacttctctcttgtgcatctaaggtggtgctagttatgtaccattatttggagaataaaatgatcattcaccatgttctgtgtttcatatatgatacctggattgagaaatgctgccagtagatcaagtgtagtttgagaaagcttatttctcacaggatagtcagatgatgttttatttattcatttatttatttacaggtttagaaatagcattctatagtatgtacctttgtgactggcatcttcagtggtttacactgtttgtttttgagacttctttggcaagtagtgatataatagcatttaacaaagaggaaacacttagatgtagagagagagccatgttagttcatggtggcagcccagatccgaggtgattgggacccacactagacaggaataaaatgaagacatagaatataagtagcattttgtgcttcaatcatgccagacttaaaaatatgataatgcttggctgggcaaggtggctcacagctgtaatcccagcactttgggaggccaaggcagaaggatcacttgaggccaggaatttgagaccagcctgggcaacatggcaaggctcctacaaacatttttaaaatgtagcctggcgtggtggcagcatatgcctgtagtcctagctgtgtggcaggctgaggcaggaggatcctttgaccccaggaatttgaggctgtggtgagttgtgattgtgccactgcactccactccagcctaggcaacagagggagaccttgtctatctctcacactctcttcatatatagctacatatatataatttttatttttataaattttatataaaatttatataatttacatatttataattttttaaaaatatacaaaatatctttttatatgaaatgttttatatttgtaatataaaaatctcttcagtttgacataacaaattaataaatttgtttcaaataatatctcatttctttcacttcgtcaattgtttgcctgaactatatgccttgccccatgaggcagggagatatatattttttacatatataaatacatattttatgtaatatatgtaaaataattatgaatgatttaaaaataaaaatacgttaatgctcttaatgttaaagtgatattttaaaggctgttaagatgcaggctagttagtaagtgagactatgtggctgaagttttgtatttagaagccagttgagccactccccccattatctcaggagcttgttgatgaggttttagatttgagtggcaaagtacagtagtaataaataaggtagaatctgctttgtaactcagctcatgtcaaaaagagaggaactggaaagcatgatttcctccctagtgctttcctccctagtgcggaaggtgagtaggcagagcctcaggcaaggcctgataggacaggagggacctgtcagcacacgtgactacaggggtatggaatataatggctggcagttgctgcttgagttcttcctaggagcatcctcactgaacagtgaaattgatctcattgaagaaatcacctttaggcagaccatcttgccttgattcttaagttcttatttctgttcgttttttcctcttgtttgactttcacattggatgtcttctcaacattatgttccaagcagccacacactcttaaatatatatatgtatgtgtatatacatagagagaaagagagataaggtctcactctgttgcctaggctggagtgcagtggcgcaaagtcaccataagcactgtcttaacactatctttttcctttttcaagagctggggtggaaaggagaatggctttggacttgcagaatgttgcagagacttgcatatgatggtaagtaactctttgggatatgggtgtcttttgacagagctgtggcctctctgtgaaccttactttacaatgaattgtggtatatgaagtgacgccttcacatcgagacctttgaggaacctaagatcagttcagacatagctgaaccacgtctataggaagcagtctagcagtgcttgggctcttgatgtgctggtggtagataaaaaaatctgagaaatagagtgtgtgttcatacccagttcttgagtaggtagctgtatttgttgaattaattttaatgtgattttttttaaatcccagaaagtatgttcgcttgcattctcacactggaactattgtatcagaactctggacagtgtggtgtgatttaggaatggctgcttggagagcagttctaccattaggtttattgagaacttataatgttttatgtgctttccttgtttatctctctgcctttcacccatgtttaagttatgagctcaggccatcctcctttctgctttgatatgttgctgtggagctacaaaacacaatttgattttcaataattattttgcatctggaagcaactatattttccacgtgggatttgtcttgtcagtttgtcgtgtttagcacaaatggctgcagtgaaatttagtgtatttatcttagcaagcctttttttcctaaagagaatggctcttttctggtctcagaaaaccacagattagatcaagttactttcccacgttagctggcatacttttctttagtgattattttatgaagagatattgggtgatacagtaggtgagtgttgtctgtttaataatcaaaactacataaatcttgaagtatattcagagtttggaattctaattatgacaacataaaggttaacgtgtactttaaaaggaagtaatacatatacatgttaaaaaattcagagtataaagaggtatgcagtggtaacttcttaattttccagaggcaaccactgcaagtggtgtctttcagtgagacattttagtgggcattctgctgtcatcttaattttgttcatcatgttgcttttctagagttaaagagaatgttttgtcagggtctggtttatgttgtcttggtatctacctgtgcagaaaacataccatgagaagtggtgtagaatggtatagaaggaaagtgtttgaagaattatgaagatatgcctatgaggcatactttgaattaaatatttcagaaggctgatgataggtacaaggtttttcgtaggaatgttcttttccattctttagctggtttctgggccctggtatttgttctccatcctttcttggattcttattcattactgcttggcagtcttgcccctcttttcccccttgggaatagccacagtcaaaattgatctcttaaagggaaactggaaatttataagtatgaaatgcagaaggtttgggagctctgggctctgtccttttgattctgtttgaaaagtctcatcctatctgagctctgctctaagacaaacagttaaaggcactgtaggtactgaatgtactgcttattcttctgccacaataagttgaacaagtggctaggactttgagggaagatgtgggggataatgtttataatcagttgaaactcaatgtctgattctttgatgtgctttatacacagaaatatccacccagtgcaactacactacactttgaattctatgcagatcctggggccgaggtcaaaattgagaaaagggtgagtctgattcagatttgttctgacaaagtctacaatttactgtaactgggattgcctcttctagaactcctcagttaaatgaataaatggttttgagctacactgctgccctcgcaaactataaatatacctagcagctcctcaggagtgttaattgcatccccaactctgatagggttgggtcttatgttgggagctgccaaaagatgcaagtcccatccattatgaggcactgctatgacctatgtgcttttcccacagtctctgagaattccaacatgtagtatagtagtttggatggtgatggctcaggtttctctaattaggaagcctgcaaaagtctttatgtattgtggatagtgtcctgcttaaattatctggtcattttgtattgtttgaggaggtactaaagagtttggtttagaagtagcttagtgaaaatacaatttctcttctacctatactattcaataaataaataatctttctagcttaattgccttgaaagcaactctaatacatattcagagagaaaatattttcatgaatttggtctttgctattaatactgctatggatattaagtcagtggagggttaaaaaaggacaaagaagaatatgaaatgtgcctggctatgtgcattatagtttgatactactggttttaaaggagctttcctaagaatattctacatataagatggatgttttggaagattctcaatttaccttgattttaagagcattcacttaggcttcagcctattaggtgacatcttggttttcagacagccctttggagctctatggaaggggaagctagagtgttcagtgactccttacagctctcttgtcttttttaattttagacaactagtaacacactacattatattcacatagagcaacttgacaaggtaagaggaatctttgactcttggctcgtttcttaatgtttggttcactttttgttcctaactatatctttttttttaatgtagatttcagaaagcccttctgaaatcatggaatctcttaccaaaatgtacagcattcctaaggataagcaggtatgatgtggctttaaaacatccacaggatgtggttgttatctaaatagattaatgatatgtactggggtgggagattgcatagcagaaagaatgtcagctttggagtcagaccatgggcaaattgttagcttctctgagccttagtttccttgtcttttatgaggttaacacttaataacttcctaggccttatgagagtttgaggaaaacataaactacctcaccgtgagcaggtaataagtggtggtagctttctgaacacttcggatatcaaaggagaaaacgtttagttgtgttgttttttgagttagccctcataaagaatattcacctttttcattgatgtttttaaaatgtatgtcttatctctctacagatgctgttatttacacacatacgactggcccatggcttttctaatcacaggaagcgattgcaggcagttcaggccagactgcatgcaatatctatattaggtaagagaagaatactttaattaccaggccgtattagacagtttgggcctgatttcctttgaacttcattcatctttgttgctatgagtcctattatagttacctaggtagcaacttaaatacttccacccctcccagtgttcactgtatttattcattatccttgagctccttaatgttggacgagaaagagggtatgatgatgttgattgacatgtcacctgggtttattcttggtattcgtctctttttttttttttttaatagatatgcttgtagctatcgttcactgtccccctactctttctcttgccattgtgtcttcctcctctctcatcctttcagggatatcattttgaattaagtcacaaaatattcagtagtcaatactgtgcatttaacttcttttactgtggcacagtaaaatggaaaacacgtggttttgtaatcagtcctgtactctgtccctgattctgtagattattagccacacttatcctctcagcctcagcttattcgtttaatattgaggtactcaccgtagaggctggtctaaagattaaatgaaaacctagaaagcaatctagcacagaacaagcacatagaagatataaaatggtaaccattgctgttattattgatgttcattatgttatgacttgccttctcttaaactatgagtttcttggcgtgaaattcttgctcttttatgtgtactcatatctagcatgatttctggcatgttagtgggtgctcaggaaatctttgttgaaaactaaatgaatatgcctaaatcccattagtttatgcttcagggtactgtgtccggtattaacctcatcgtggaattcattgaatgtgaattacacacattctgaagttttactacagtgtcacacaaatttctgacttactctgcaatggtccataaattctgttctttacaagtgtttacagtaaaagcagaagcataggaagaggctaaaatggaaatcttatattgaaggcatagtggagttacatcaagtagtaatgttatgaaaaattaactcagagcttttcctatttccatccccaaaattctttctcaagactaataatacctttagtagtggaatctgtcaattcagtgtctgtttagagattatcagttgtatttgatccagtccttcagaatttaatttggtgatgattctgccctccattgctggttgggaatggaattcttccccagaacctatagataccaaaaagtttgttattgggcagtggcttgaccactgccttcttgcctaaagtgtttgtttctccttttgcagtgtattccaatgccttgcaggaatcagcaaacagtatcttgtataatggcttgatagaggagttggtagatgtccttcagataacggataagcagcttatggtaagtattttacaggttgagtaacccttagctgtaacacttgggaccagaagtattttggatttgagacttttttggggggggaggggatatttgcatatacataatgagacatcttgggcatgggacccaagtttaaacacgaaattcattgatgtttcgtatacacattatatacgtagtcttaaggcaattgtatacaatatttcaaataattttgtgcattttaactgtgacctgtcacatgagatcaggtgtggaattttccacttctggcatgcaggtattcccaaagttttggatttgggaatatttcagatttttgaatcagggatcctgcattaatgttctctgtatatcaggcttatacttgtttgccttttggtttttcccagagggttagaaagaactcccagtacttccctctttgggtattaaactgcaaaactaacaaatactagattttcattgttgctctcaacagacctccatcccctcaagcagttaccagtagaatgacttatattttaaagtttggatattagcaactggaacttggttcagtcatcttattatatttgacacattatgtgtttaccttctaatttaataggagattaaagcagcttctttacgaacattaacatcaattgtccacttggagagaactcccaaactcagcagtattattgactgtactggaactgcctcctaccatggatttttgccagtgcttgtaaggaactgtatccaggccatgattggtaagttttgatggtgattatcttaggcaagaagaaacatttgccctctgcctttgtctttttaatatcctgcctgcttaacagcaattttgagcttgtttttgttctccctctccccacctcccttgtagatccttccatggatccataccctcaccagtttgccactgctctcttctcttttttataccatctggccagctacgatgctggtggtgaagccttggtctcctgtggaatgatggaagccttattgaaggtgctgtactttttttttttttttttttaaactacatggggaaatcaactaagggtgtagagatgcaagtttggggtgtttcacagtgagggcaaataatataagaaagcttatccagaaaaagttatacttaagtagaaggccagtttggctttctagttatctaattaacaatgtttaagagcagctacttccattattgagacttttatcatagtgtagaatggtcaggaggtcatgggttctggttaaaacattgccacatgttatcatgcctttacacaaccatagggaaaatatatgtcagggtactttgtaagttgtgttgtagtagtaatagcctttactatgtgcagggcaatgagcaccagcttttttctccctaaatatcttacttaatcctgcaaagtaattgatgtccccattacctcagaggttgagtcgcagaagtcatagaactgtcatttggcaggcaccaaaaataaaacacatgttttcccccatactgtgctgccttactgaggccccagactacatgtatacaaaagcatgcaatttttacaactttgtgtctttatagttcattgtttttgcctctttttctccgtgataggtcataaagtttcttggcgatgaacaggaccagataacatttgtcaccagagccgtcagagtggttgaccttatcaccaacctggatatggcagcttttcaatcccatagtggactttctatcttcatttatagacttgaggtattattatacaaggaatgctttgcacagaatttaatactcagagctgaacctaaggattgtcctgataaccctaaagagcgatcttacagtctcttctgtttctagaaatcaactgtgtatctgcttgcagtgtttttccattataatagtttttaatccctgaaaaaatatatatatatatatatacttgattttcttataacctttctcttgattgtagcatgaagtagatttgtgccgaaaagaatgtccgtttgtgatcaagccaaagatccagagacccaatactacacaagaaggagaggaaatggaaactgatatggatggtaattaacagttattaagtcagtatttttgtgcttgagattttttgtcatcccaccccagttttcattcttcctcataaattccaaagtacacaattaacttgagtatatactttcagcaacaaaaattttttttctatgtaagtgatttgcaaatttgtttttcacaaagataataagaaaagaaaggtactagttctttggagtagagatggcaggtaaagcagatgctatagctgtggtgttaatctgttttatttcatcacgtaattttcttatgtatttcttattgtcttatttctactaaaattcaagctccatgggatcaggatattgtctttttcactgccgcagtgcctgataacatcctaggtgttagaaatatgcttggtagagagagagagactaaaatgggaccttttaaaactttacctattttgagaagagaaaggagaggtaaaaaggttgttgggtaggcaacaacatccgttaggctggcacatcacttgagcccaggggttcgaggccagcctgggcaacatggcaaaaatcttgtctttacgaaaaatacaaaacttagccgggtggggtggcatgcacctgtggtcccggctacttgggaggctgagttgagaggatcatctgagcctgggagtttgaggctgcagtgatttcaaaatgtaaatagtattttatcactgatggagccttaatacattttataaactgtagtcaatgattgtgtatcttatactcagttattcaagtgtataaagtaaaaatgaatgctcacttacctaccatagctactagtttcggtgcggatctttccaggcttttttatgcatattcaaatacatgttgatgttaagtatgtatgtagtattttagaatgggaagatgagatcataaacatactgttcatcttgcattgctcattcagtgtttcatagacattcttccagatcggaatattgagtattaatcttttcatgctttttatatttattaattactcttttgaaaagctgtacctatttgtatactaccaactagtagtatatgaaattgcacattttacttaccactctccccctcttccccaatttggtaggtgagaaatattgaaggacttctgtaggattgttaatttacacacacacacacacacacacacacacacacacacgtgtatgtatgtacgtattaatacatgcaactagtgatatattttcattttggggttcagtattcctgatcttcatttttatattcatttcacattaatggaagaaattttctcaaacaaaatttttctttttgtggtaccttttattctagtaagtttctttatcataacttgtactttagttgcagatgtggctatggaaagcagtccaggctcatccatctctatggagcacaggctggatgttgaattaagggcatcaggttccagcagcagcactaacatctcttctggccccagccctggtcccagtcccggcaccggccccggccccggccccggccccggccccggccctggccccggccccggccccggtcctggtcccggccctggccccggccctggccctggcccccgtcctggtgcgtacacacatagatgtgcagtctttcagagtggtagagttattaaactattgaagaaggcggctttaggcagaacttaaatggtacatttggaggttagcatcccatgactattcatgctccttcaccattctggtgttccattttcttatattaacatgtctttcatagcattttatacttttccaacaatttgcacattgattatcaaaacagccatgttggagggcagataatatccaaaatgggaactgagtgaggtaaaaaaaaagttgaacctttttactttgtaatttttcttttttactttagacttttagtattggtaaaattaaaagtattagtaatttttccaatttcaaagcttaattaagtattcttcctaacattcagagacctcacttcgaatgtcttctaattttattatagtgtatttggatctcttaaaattttgttttatgtgcttgatcattgtggtttaatggcgaactcagcataattcttttgtctttcttcattgccaggagtccagtgtattccacaacgagcagcacttctgaaatccatgttgaatttcctcaagaaggccatccaagaccctgctttctcagatggcatacgacatggtatttgattccagataactttttttggaggatattttactctctcaaagattggttcttttcatactattctggcacctgttgttttacaaggcagtctttggtaaaggccatgccattttcaatagcttttagttgttttgtgtcacttttcctagatgtaagtgttgcttagctattttcataatgatttaccctttttttccccttttccagctttcgactctgtgcttaattccgtcttattacccctttctgactcttaagtgtttgtgttctttctttttttaacccatgttagaaagcctattgcatggacaaataataaaataggaggagacaactgggggccattagattagaattaacacaggctttgaggaccacagtgtgataatacataacatatcactcaattatccccactcctcacacctttccagactattcgtattctccataatgttcacttttcttttagtgatggatggttctctgcctacctccctgaaacacatcatcagcaatgcagaatactatggcccatcactcttcctcctaggtaagtggagttgatagttggttataacaatttgggataacctggcagagctctctctctctgtatttacttacttacttatttacttatttatttttgagacagagtctcactctattgcccaggctggaatgtagtggcgcaatcttggctcactacaacctctgcctcccgggttaaagcgagtctcctgcctcagcctcccgagtagctgggattagaggtgcctgccaccatgcctggctaatttttgtatttttagtagacaaatatgaatagtaaaatcctgcaaggatataaaacacagagaggccgggcatggaagctcctgcctgtaatcccagcactttgggaggccgaggcgggtagatcacctgaggtaatgagtttgagaccagcctggccaacatggcaaaaccccatctctactgtctacctggacagtagacaaatgtcaatagtaaaatcctgcaaggatataaaacagagaggccgggtagatatctgtcttattggtgatgaaataaaggtcagaattcagttttaagtaaatacctattttctgggtgctgaatataccttcgataagtagtacatttgtagtaagtaacattatcatacattttgtttatctgtgctagaattcttaaaacgctaaaggaatttagtaggagacgtggaaatagggaaagtctccttgtagtagcaagcattgtgttttacagtttggggtgttggggagactagttttggctactacaacttagatacttccttgcccccttgctgaagaaatttaggatttttgtatattaaccttgtatcttttaatcttgcacagttcacttattagtacatacttgttttgttttcttagaatattctacataatcttgtcatctgcaaatgcatttttactttgtttatggtctttgtgcctttttttttgtcttatgacattagcaaagatttctgatacagtgctggatagaaataagaatgggcctctttgctttgttcctgaatttagagggaaaagcatttaatatttcaccattaagaatgaagttagcagaggttttgtgttgaaggttttgtcaattttgtcaggttgaggaagtcttcttgtggtgtagcaactctaccatgctatggaaaagctctctgctaaggttatgttcagatggcaaaattcagacaatagttctttggggtttttttgtttttttttaagatttgttttacggtggggacgtctcaaggccaggggcagggagaatgcccgtcttctgggagaaagtccagaacagagagaaagagaaaaggatacacaggcatttttctataaatgggaagcttagaagaaggagcaattgccattgacagggatattgtttaaaagagggaggcagcaagaggatatagtgcttaggtgctgggatagtggtgaggagcaggtgagccctatgaggatgatgccagaagtgagggacacgggcaggaaatgagacttagagcactaaatcaaaggtcagtgaaggtccaacttccttccctatggttttcttaattcatccctcacatttaaattagcatagcaacctcccagttttcccataaaatacacttgtacttgagagagaacaaatttgcaaagcgaaacctaaataattagactagccattgttattttagctccccaaatgatagtacagagcctttcactccaggtggaaggagatggcccaggaaagacatcagggagttctgagaacctcttggagtattttaataatataattggcagtttgggtttatttttgttgaactattctggataccttttctttattaatgatcatgcaacaggaagtccctttaaggcacaagcactatcttgaaatgccagtaggtagtttcatgccagtctgttatcaactatcatagtaactaaactgctttgtccctcattgagggcttcttaggcctgaactgtttggttaatgtggtctgtcaggagttacaacatgtctcggtaacctctatgagttgagtctgtgttacagaattggaaatacctaaacttgtgcccgttacaccaaagattctgatgaggcccagaataggtaaaaagtgctcctttttgtggcaagacttgataaaacagctagactttctagttgaatttgaggtgccctgggcactaaatgtccatagtacataggtcagcttgtatgggtagaagggaacaggatcgctgaataaaatgtataaccctgctgagcaggagttgtaacacagaagaatcagtagcccaagaggttggaagttggagtttctagggggcaaacttatatcagggtggacattctcaacaggggggcatcattgtatgtactatcagttggtggcagaggctgggaaagacatgaaatccttaagggggaagtttaatatggaagcacccagtgaggtcacgatgtcctgcttataatttcacactcaaacccactaaatattctgactccttctccctcacgtgtccgacctctggctcttctatgccacttttagccacctgtatttcatttgtagtatcccatttaacttccccaactcccctctcttctttctcacctcctgccttacccctcatgttatctgttcgggtctgtttgtagcctatgctaatgtcatcatgcttatgattgaccacttaaccagagagtgtagcaagttgtcaatatgagtattgaaatcctccaagggagcaagatatagttgtatgagtagttgcctgggctagggtatctgttagtattgctggaggtttagtatgtaggtggcattctctgttactaatacatagatacaatctatcaggttgagtgaggggaagcaggaaatataggtagtgactggaatagtgaaattagagtgtaaatagtgaaagtggagtgtgggctgtcaaagagttgatggggcagtggagttatgatgagttatgtgggggcagttacaagggcagttaccatcttgagggtgttagcgtcaaggctgggactgtcagttgtactgaaatcatcatctaggatgctttggtatgctggatggatagaagccctaggctcgcacttgagaaattattataaaagtaactcagtatccctttgcctacaagagttttagaataatttcagatagggaagctatgcactgattacccctaaacaagtgggatcacagcatgggcaaaaaggagcccaagaagtttggcattgagctggggtagtagtatcccagacccagaccatgagccaaatgaggtatagacaggccaactagagccagaatattccacaaagatattttcaggcctgtggtgcgtagacttttggcatgccgaagtgccagtttattatgggaatcacaggcattgccatcccatatcctgcaatagtctcccattcaatacctctgtaataaggtggttccagaactggcttcctgtctaagaatgttggtactaggaactaacttaagatttttctttcctctttggaagaaccatacagttgtgtatgtcaacccaggcagagagactaagaccttcatttcctatgaagagggatctccagttagcagtcctttaaaaccatcatattaggaaaggactttggcagagaccttctgcatagtcttagagggtgagggccctcaattttctgtgggtcccatcctgttacctactttcaacctaggctcctgtccaccgtggatcgcaccaatatcaaatgaggaggtgtcgttaagtgagggggattctgtttgggtattatagactcatagatggaaagtatctcattttgaggctagaaaggggacaaaggaagcactaattgtgttttttcagatgtcatacaactaaggcaatcggcaaaagagagatcaatttaagagaccattgtccatttagtaagtttaagagagcattgaacaagccattatgcctctattaggcctgctttctgtgaacagtacaacagatgggccaggcactggctcacacctgtaatcccagcattttgggatgctgagacaggcagattgcttgagccttgagcccaggagtttgagaccagcctgggcaacatggtgaaatcctgtctctacaacaaataaaaatgtttgcagggcatgctggtgcgctactcaggaagctgaggtgggaggatcacttaagtactggaggttgaggctgtagtgagctataattgcacccctgcactctagcctggggaacagagtgagaccttgtctcaaaaaaaaaaaaaaaagacaaatggaagctccaaggtgatgccttgtttgaaaaggcccatgcccagactgaatgagcggtaacgtacgtaccctggtcagagtcggtgttaccagaagcccaaagggaactaactgagggctataatagtggtggtgttggcagtagttgggcaggaaggataagccaagaatgggtctgtataacaatcagttgtgagggcatagcgatttgtgccagcagattggggcagtggcccaataaaattgatttgccagtgagaaaaggagtgtttacctctggtatggtgagcccccactggtgatgatgccgatggcacgacagggcacaaagaacatattgggaggctagggtttgagtagggctagtggcatggggatgcaatggcatttgggcccagggactgtgatgaccttctgccttcctttactctcttctctgtaaccttgactttccaaactctgttggattcattttcagttctattgaagtacatctgtgggtaatttttaaggtgtcagacttctctttcagaagttggtggctgttttcttcattgtattctaatgctacattattgtagataaccatggtgtcacactggttcttgttcttatctgtatatagttcctgcttctgcctttttttttttttttttttttcttctatttctctgattccttttaactttctcctggaaaccctaattaccttttttccatttcttagttgcttggttccacacacagctggttgctctgtgcgtgtatataccctttaattctaattcttggttatcagtgtttttgtataggggtcccagtgcatagtgtcgttgcgacttcttgataaaataacaggtttgatgtcttagtaattgcttgtagaacactaattttagtttttaaatactcaattttagtaactctatagaattcatacatttctacaaatgtaagtcaatcgaggggagtgtcataccaataggaaccccaaaaaggacttaaatttttcagaagtttatagcccatgaggaatcccaaaggccattgaaaactgttggtccccggtaactgctatatatctgccattcccctagcatttgggataaaggagagatgctgtattcaccatcttgaatagaaaatcctctggtttcttttagatcttaggcatcaccataaacaagtttgttctgtatacatggtttatgggtgttgtatgtatattcctcttcatcaggttttttaattaaagttattgtagttattgtagtcttatgagttgggaagctttgtcttaattattcctagaaggtttaataaaactattggcttggtgcctctctattacctggattttttttttttttccccttttaaaaattctggaacgggcacggtggctcacgcctataatcccagtactttgggagactgaggcgggcagatcacctgaggttaggagttcgagaccagcctggccaatctggtaaaaaccccatctctactaaaaatggaaaaatcagccaggcgtgttgggtgcctgtaatcccaactacttgggaggctgaggcagaagaattgcttgaacccaggaggtggaggctgcagtgagccgagattgcaccactgtactccagcctgggcgacagagtgagactccgtctaaaaaaaaaaaaaaaaaagaaaattcttactggtctagtctgctttgctgtcacttcctgagatttgatttttatgacattttcttattaaactatacatttcacttgttggcatatagtttgtagaatatatttttctgtatctagttaaatctcctttctcattcataacgtatattactgctcttttttctaatttatattatttcacttgttggcatacactttgtagaataaattttttttttctgtatctagttaaatctcctttctcattcctaatgtatattactgctcttgtttctaatttatattattgctctattttctataggtttataagcttttccagtgtcttcacaaagctagatattggcttcgtttatcctttttgctttcgttttcactgaattcttttttctgttaattcttcatagcttgtttggttactttttaataaatactttaatgctgtactatttcctcttgagtagagtttttcccatgttccagaagctttggtagttattactgcacattttaaaatattataatgtcaaaaactgatcagattaatattcaaggactcttgcattgctggtgatagtttaaaattgttgaataacctttgtatgaggcagtttatctattttcatcagtaaagcttgcatttgctttaacccagcaagcccacatcatagattttttttcctgttaaaagcagacaaaaacggatatatgtttaggtttatcattttcacaattgaggactggtttttatacatgtggtacatgcatttagtggaatagtaggcagccattcaaaatgaatgggtcgttgtgtcgggagaggacattatacggtatgacagttgtgggggaaaagcaaaatatataaaacagtgtaacctcatttatgtaaaaatatgcccataaaaatcctgtaagtgtagtcactagattctttatagtattgaatctctgatggagcagtattaggatctttaatttcatagtaagcacaagggtttaaattgctagacattgagtatgtatttttttttaagcttttggtgttttgttttcagtttctgtgaggaatctctcagttttccatattttctcatctttttttagctactgaagtggtgactgtgtttgtatttcaagaaccatcactgctctcctcactccaggacaatggattgacagatgtcatgctgcatgcactgcttatcaaagatgtaagtcttttctgctactctgtaaagaatgtcttagggcgtgaaaatcctatctcttctgtgtgtagtgttgaatctaattgggacctggttgtcaaaattccttctatctcagcttgatacccatggccggattttcctagcatctacactcttttagatgcattcaagctcactttgttttctctttaggttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggtaagttgttaagatttattttatagtagaaaattgatttagtttgcaaggaaactcttccttgatcatctctctcatcgttttactggttaggtgtgctaagtttaatgggaattatcatcatacattctattatacttcagaaggaatacttcagcttctctgctcataatatttccatgcttctcaacagttcaccattgtactttcatggtactggtagaaaataggtattaagaagcagtggtagatttccaggttcaccatctggtctgcagcaatgagaaatatggagtcctgaggtgttcatctggtaatctagtgttctgatgtccaactctctaagataacgacacatggatattttttttttactcagtatacttgagaccagataattgagagattattagcaaaaaggtagggctccagaaagattacagttttcaaaaatgtgctttgtacttttcaaccaccactgtagcatttagacactatcattcttaactggagcagccagagggttaatggtttgtacatctttcttctctctcactctgtaatactagtttagatcttgacagcaaagattgccagagtagagtgcagcacacatagttactttaaaatagtttactaaactgattccttccttttccctagtgatttggggggataggggctgggtgtaaattcattaaagaagttgtggcattagaaaatcacaaccaaaaaaaaaaaataggaaaaaaatatcacaacagcctggcctggcacagtggcacacacctaccattttgggaggccaaggtgggcagatcacttgagctcaggagtttgagaccagcctgggcaacatggccaaaccccatctctaccaaaaaaaaaatttctccagtcacggaggcgcacacctgtagtcccagctacttggagggctgaggtgggaggatcgcttgagtccaggagatcgtgacactgcactccagtctgggtgacataaagtctttaaaggaaagaaaatcataaccaggctcagtttcttctttccactttatatgttggtacagaaaagagcccaagctctattttcttcagtctttctaattctaacagttcattttttgccttaaggggatactgcatccaacctggggagtgctgtcgatgagctcatgagacatcagcccacccttaaaacagatgcaacgactgccatcatcaaggtagaaagtgataaggatgtgaccatgagcatgagagagcagagaaggggaaggttttagaagattggcctactagaggtcattaggattcttgggctatagctgtaagagcattatgtctgcctcattgtttccatgtccttaggttggtcctttataaaaagatgttgtcattttagttcatcttagaaagaagtctctgttaaaatttttttagcctgggtgcagtggctcacgcctgtaatcctggcactttgggaggctgaggctggtggatcgcttgaggccaggagtttgagaccagcctggacaacatggtgaagccccgtttctatgaaaaatacaaaagttagccgggtttggtggcgtgtgcctgtagtcccagctactctggaggctgaggcaggagaatcacttgaactcgggaggcggaggttgtagtgagccaagatcatgccactgcaagactctgtctccaaaaaaaaaaaaagtattttagattgagaattgttttccttaaaaatttttttccatttaatgtaacctgtatataatgatttcttttatatattatatggacaagcagacatggcttagattaagtttgtaaagcatattaccctttctagtctccgtttgttgatccctgtggctgccccccacccccgccttattagctctgccagtttccttttagaattgttgttgaaattggtatataagttcctggtgcttggtgaattgggacagggagtcaggttcgtcagtcacttatacagccgtgtgacgctcaacaaattatttaagtttgcagcacttctattcccttgtttataaaatgtaattaatgaccatattctgggaattatgtatataacatgtatacaaagtgtttgggcaaatacacaacacatagaaaacgctctaaatatgttagctgtctcctcctccccattccatgattactaataagtaatcttatttcctgtgcctttcagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcagtaagtgtttacagaacagatcatctagccatataatcgtgggcatgttatcacctctctaagtcttaatgaacactttcatctataaaaagcaagagagttgtattagatcattttaaagttctaaccggttctaagaatgtattagtttttccttttttgacccttgtgtgtcatttgtgctttggtatttaattgtattggttgccttaggaagtgatctttttttaaaaaaattaattaatttttaatttttattgatttttttgagagagagttttgctctcgttgcccatgctggagtgcaatgatgtggtctcggctcattgcaacctccacctcctgggctcaagcagttctcctgcctcagcctcccaagtagctgggattacagacacctaccaccacacttggctaatttttgtatttttagtagagatggggtttcaccatgttgaccaggctaatctcaaactcccgacgtcaggtgatctacccacctcggcttcccaaagtgttaggattacaggcgtgagctaccgcatccggccaggaagtgctcattcttaaaagctgttgatgaaattgaatcagaatttggtccatcaagttaatggactttgcacagagaccttattttccctttgttgatttgatattccacatcgactgcttgatttttttcaggcacgtgtgaaaaacaatgtacttttgaagcctgtctcctaagaagtccttaaggggtgtgtgaagatttgttgttgcttgttgtttttttatttttgttcattttgttactatctgttcgttccagattaattagtagaaggctttggaatttactatatgactgtaaatagtcaagaattgactgcttagatggaagcagggagtttgcttaaaggcttagtgattggtagggggtagtccaccaggctctttgagcagtattcacataccagggatgaactgtaactgtatacctgtaacttttagtcacctgcatgctgaaaatgggattgatctttctggacagtcctgcactccctcatataataagtggtcttttagtgtgtaggtaagtcattctgagaaaagcttgagcattttaggcacagctatgaatgcatttgagctggtcctgaatggcaccttgggacttaaaatttaaggtggagttgacaacaggagcaaaggcctagaatccgaaactggtatgtcctcttggaactctaaatagtgatgagcctgtgggtgtcaagtgttttaaggagaggcattaactactaagtatattgctttgttgaacagataccttaccctgtctgagaaggcaaacctatcttcattctagcagtatcttttgttctcttttaaatgttctttttctagaagaggaggacaccctggaaaaaagcacgacttttttttgtagacgagtcttagtgcttcctttgtcacacccttgaatgtcagtgaccctactggagtgtggggttccttttcctggctacaaataaggaaaaattttaaggtgtaggtggtggtggttttaattcaagctcatatatattcatctgcatgtgacgtccctacctggatattttccagatgccttacatctgatgtgcccagatttcaagctgacacagttaatcagcacactaccctcatttgcttaccctcctttcctttcttgggctatcatgtatcactgtgttctatccacagccatccccattcccacatcacctccttttacatccaccagatttctgtaaggctagttcaaatgtcttattcttgaaggaggtaggttggttggttggttggttggttttttacctccaaatgagaactcaatcttgtgttctcccaacagttttgttaaaattattcatacatgttaatggttttcctcactcacctataagctcctcaagagcaagacattgcctcattcaccagtgtatccctatcactttgtatatagtaggtagtcagtaggtttgtttattgaaatgaataaagagccttaaatgaaggattcctgaagtcttaaatgcttagagagctaggcctaatgagacatgaatgaaaatgaagagaaattagaaatataaacccagtagcattaatattctaccacagtgatagttatatgtaacttctaagatgcagaggactctagtagttactgtaccccagtatcagtagttttctacattctggatgctcatcactgcctcatttggataatccaggagtctcacagatgttgacacatacattttttcacttttgccatcttcagaggcctagattgggtcactaagtaaattattagggaaggaagaaaaagcaagagactgtctaaacttagcttcattttgaaaaccacaatatattaacagcaaaagttctttttatcttctatcccaggcaattgttataggggaattgtgtactttctcacaatatggtgaaagggcttagaaagatttggaatatgtgtcacccttctccccagaagtcttgcccatcccttcctccatatccatagttcttccgaatttctgtttcccatgctctcatttgttttccaatgccttatacacacataaaatgattaacttttatctttattttattttatttatttatttttttttttttgagacagagtctcactacatcacccaggctggagtgcagaggcacgagctcagctcactgcaacctccgcctcccgagttcaagcagttctcggtccttagcctcctgagtagctgggattacagacacgtgccaccatgccttgctaatttttgtatttttagtagagatggggttttgccatgttggcctcaaactcctggcctcatgtgatccacccacttcggcctcccaaagtgttgggattacaggtgtgcaccgccgcacctggccaatttatcagcagtttaaattcaggtatgatttccatacagattttacatttccagtttccctgcccaaaattgagactgttactcatcttacttctgtcatcatattattatgtctattccagaatatgtttaaataaaatgaccatataaagtcttatgtgtatattatatctgacgtatataccttcttgtatctagcttctttgtttgatgtgttttggaggttcatccatgttattgcatctgtcagcaacttgttacttttcattgctgagtagtattctgttatgtgataattgtatagtgattatccattttcctgttgatggacttgggtttctgagttttttccaggcttagacactaccctttctttttttttttttttttttttacaaaatcagcagctagtatttgcaaatggtgtttgtatttactcttgaaatacatggttttgtgctggagatttggagtaaggaaacttaggcactatagtctacgccaggtacgtggggtgcctttctacactcagactcactcaccacaagtagttctaaatacctgtcttttgccccctttcttctgccttctgaattgtttgatctcagaaaatctgatattgctggggatgaatatacttagcagttaagtaaccagggtttgtagttggtgcatcacggttcactttgtggttgattgcattagtgtgcctagcttaccacccaccactcatgagcagcttgaaagaaatggactatataaagtctttgtcatctttagaacttgaatagcaattgtctggaatttaaaggcaatgagtgcagagacgcagttgttccctgaaatgtggcccactgggagggctcctttgtcagagtcagctgtctcctcaaaagctggaggaagcacctgaccatccccccatcccaaaaaaccccatatacatcatactatgacactaaattgatatcctcctttacttttgatgggggcatgagctggggctccaccaccataaatactgaaaattgaccagagtttgggaatgtgtgtatgtttggggaaagggagagagacaggaagtttagaaggacttttcttgaaatcagttggtaagttgagtcctgttggaaagagttgatcattttgattattcctgtatggcttcttgggcctgagagccaaaagatgaggggaaggagaaaagtggttactgaacaaatttattcctgaaattatattaagaaccactattggtttgctttctctctgttcttctccccagtttccatgtagcaaatgaagggggcatataggtctcatttgattttactacttaggctctttgccattatatctggcttcttcaaagggttgggtgtctctgggcgggatccacacctgcactccttatcgatagaggtggatctatataggtaattgatataagtaacatggaatgctgcagtggttctgaggaggaacttaaagaaaggtttgtggtcttctcatggaatcatttcagtcttgccttataggtatactccctttctacaaagttcttccccacatttttcattgaggaggttcacaacatcctacccaaacctggttctgggtatttttgtcactgaagtcattcataatgcctctccactctcttttcctgttctatattctgctgccaaatgttcttgtgcctggcaaatctttgtttacattttgtcttgctcaaagatgagaactactagcttcttgccaactttcttgtcttcttcctctacctctccctctgtctctgccccatcccgctctcctgcaccctgtgcccaaatctgtttcaagggcctgtgtccaaaatactccattttctaaagtatttgttccttcctggggtttatcttagaggtatattttgattcatcacaatatactatatgtgtagttttttgcattgagctgcattttctgcagctgtggcatgttgtagccttctcatctgctgtgcaatattgaagcaactgaaaagacaaaagacctgatcagttttttgatagttcaggaactgtcatgctgcaaataccaattgttagggaagggagacctcaggtgtatgaatctttgaactaaattaaattgtatttcctactctccataactttaaacgtgatgcaaaaacatcgtatgatgtttaagtgtttctttgtctagcctctttcttcaagcaaatgttgagtcttttaattgaacttatttttagtgttctcatgtggataaatttccctaacagtagtttgccaaagataggatagcttctcttgtgatgtatactaatgttgagtttttaaaggcttggttgtcccctttatgctttcaaccttggtcaggcttggaaaggtagattcaggattgatttcagctgtttttttcctgcggtatatgagtctaaaggctcatctctaccccataagcctgggaagcaaaggctgcagtgagccatgattgtgccactgcactccagcctgggtgacagcaagaccctgtctcaaaaaaataagcaaataaataaataaatagaaaaaggcctagaattttatacagtgcctcctcctctgttctcttaatattggtattgtgaatttctgtgtaactcactcttttctcccctaacagggttgttggtacagaggaacgtattcctattcccctcatggattacatccttaatgtggtaagattcaacacagggcaaactgagtaaagatgtatatgtgcttttctggaaaatgtgtttcgttatcagagtccagtaattaccgtattcattttaattggaatccaattaagaggggaaagatgtgccacccttttgtttttgttctagactggtttgccagaaattagccaacacaagccccattattttgtattccagatttttttgttcactgttaccattctccattagaatccagacaggaatctgtaacaggttttgttttgccagtctagtacaggctgatcatcccaaatccaaaatgctccaaaatttgaacctttttgagtaccaacataacactgaagggaaatgctcactggagcattttcagcctgtactgtataatgcaaatattcaaaaataaaaatctgaaacactcatggtgcccaagcatttcgaatatgaaatatacaacctgtaatatgttttccaaatgtgtccaacatatattttcccccttttttcccattacttcctgggtatctcaccaaaaaagtgaagagtttgaattttcccagaattgtttaccaataagggagagacctcttagcatttgtttcagcctactaatcacttccaagacttccagagatagtttgtcttgtgcctgtgtgtttattgcccacattttacttttttactcttaaaaaaattctttgtttgaaacaaactcttccagagttcagtgtttcatttgcattatgcgtttcatttgcattataagcacatttgggggaaattttccatgatgtttgcctgcaggagagaggtaggcaaggagcactaaatagcaaattaagagattaaacatgattgtaccactaattcataatgtggccctgagcaagtcacttaacttctctgttatctcgaaatatctgattcttggtgtgcttgaaaatggagattgggcagaaattgtagatattctttacttcctggatgttttagaatccgtatcatacatctggtttatctgaggttttgatactctatagaaaacactaatatcatgactagaaggctaccccatccttattccaggctggccatttagttccacctgtcaggctctaacttctttaaaaaatttttattacctagatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattggtaagaagcatctggccaaatgttttcatttctttctggaaatcaattttgcgatacttctgtatatatgtttttactatggtctcccttcaactaaaaaataatgaataaatttgtgttatgttgtataagtgaattttgtgactaatatatagtgtgccatgttatttctcattgaaaagtcaaagtattttttctttgttcatcggttgggtatgtagttctacatcattagagtttattggagggaaaagtgtatctccaagaaagcttttctagttgggttttattagtacctctcccttctttgttataggtgcattttaaacacattttatgtttatggttatgtttaaccatgtattttcctcccctttcaagcttggtagtcatgtattttaagcataattgacatgtagttcattgccgatacttaattccccccttttcaagcccgatagtcatgtattttaagcataattgacatggtagttcattgctcatattttgccaaaaatgaagcttctttattttttcatagtggtaaactacacataacatgaaatgtatcatcttaaccattttgaagtgtagagttcagtagtgttatgtgtattcatattgatgtgcagccaatctccagaactcttttcatcttgcaaaaatgaaattctgccattgaacttctcatcctcccctctccccagaccttggcaactaccattctattttttgtctctaaatttgactactctaggtaccttatataagtgggatcataaaatattttgtatgtgcgaccggcttttttcacttagcataatgccctcaaggttcaaccattatgtagcatgtgtcataatttccttcccttgtaaggcctaataatattccattgtgtgtatataccacattttgtttatccattcatctgttgattgacacttgggttgctttctccttttggctgttgtgaataataatgatgctgtgaacatggatgtacatgtaactctttgagactctacttttaattctaattttcccacatcctagccaatacttattttctgttttttgataatagccattctggtgggtaggaagtgtatctcattttgtttttcactggcatttccctaatgcatagtgataatgaacatcttttcatgtgcttgttatccatgtatatatcttctttgtagaaatgtctattcaaattcattgttcttttttaatcgtgttatttgttttgttgagttgtaagagttgtgtattcttgtacacgtattaatacctgatactaatttcttctcaggtatatgatttgcatatatttttcctgttctgtgagttgccttttcttggttgtctttggattcacaaacatttttaatcttgataaagttcagcttctctttttttgtttttgttgcctgtgtaaacacctgtgtttttggtgtcgtgtccacaaaaccattgccaaatccgatgttttgcagctttcccactgtggcttcttctaggagttttataacttagctcttatattcaggtctttaatccattttgattagattttttatatggtaaaagtctgtcctttcctattgcatggtcttggtacctttgtcaaaaatcatttgaccatatatatgtgaagatttaattctgggctctctattctattccattggtctttacgtctgtctttatgccagtatcacagttttgatcactgtaactttgtaatagaaatcaaaaagagtgagacctccaaaaatttttccccaacttgttttggctatttggggtcccttaagatttcatataaattttagaagggatttttctatttctgcaaaaccaaaacaaaaaacagcattggaattttgatagtgattgcattaaatctgtgaaactcctttgttagctgggctgcagagtgataagtaattcctgctgaatgagaaatccatttgcttacagacttggaaagatccataattgtgacgtgacttcatttagtttattttgttttactctttgaaatattgaattaaatgctcttcatcacagagaggggaaaatatcctataagatgctgtggaaggatagatagatttatttaaagccataggaaggcacatgatttctcctatctttgcatggcaagtgatggtgttttattgtcagatttttctccagacttgagaggaaatcacaagggtcgtataatccttgggttgtctgataaaaacaaattgcctacctgattcctatctcagaataatcgcttttgttttaagaagaaaagaacagtgtaatagtgactcacttccatgctttggaactttgcctaacattgtttcctatcgagcaaaatttggaattaatcctatagtgtagaatccttgccgtaacagtattcagtttgaccatcataagcttttaagtgttattggctcaccaagtttgaaagtagtgtgttgctctagaaagagatgttaaggtatgttgtacctgacttcatatttgggttccaccatttaccaggtgagagaccatggccatatccaaaatctgagaggcttccatttaattgtcacttccattgtgactattaaaagacatgatgaatttgaagttcattgtatattaacactttaattattcttcctgtttcagacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacaggtaaaaataaccttaggggtgaacatattaatttaaaggcagtgaaatatctagggcatacacctagcagggttactatgcttgaaaggaggtctgcctgaggtagcagctaaaagaacagtccaatttaggatgagatttttttgactgtcaaaaagttgagtgactatataacttattatgtgatgaagtggactttcttgagagcgaaacatgttattacagacaaacatcaattgggtattcatctggccttagtactttctaatctttccaccagtccttataggtctgataatgggatggcataggtaggacattttaccaaagaacatttaaatcaatagtaattaacaaattactaaaaattttctacatatcaaacgtttgacctgtaatccataatccatagttccagaaagaaggcattttgtgtatgtcctcacagttttactacatttattcctcagataattgattctaaagatttatggtatcaacattaaacaaaacagggttcaacagccctgttttatgctattgagcaggagtgtgttctctgttaattgtgaatcaatcaaatctgaagtttaaaaaagcacaagtataaaggatttagaaaattaaattacttaacaaagcttagggattgatttttatgacttctttattaaatgaaataaaatgaaaatgaaacattcaaggaattaaataaatctaggtacttactgaagtaaagaaattgaatggaaataataatacccctaccaaataatttagaaagtagttaatgaacctgtaaaaccatttctttgattcagaaaaaaagagtagcctctgatgcctttctttcactttataaaaaacaatgagaacggatgttgtggaaatagtttgtaaatattgtaagaggataccttgtggaactgtcgtcttgagtgtggacattttgatgaggtggataactctgagaatagcaatgaagaaaaatcccttacccttataaaactgttgaaggtcaatttttttttttaagtataattgttcagagaacatcccaaaggtgaaattcttgttatgattgcagagtgaaattcgttccatctccgtaaaccagtggggctctcaattgggtctgagtgttttgagcaagctgagccagttatactgttccctggtgtgggaaagcactgtcctcctctctctgtgtaccccaaacaggtaagagaatggctctctctcttattactttgttatctaagttcggtgagcctggaggattgctttggttggggataggagggtatggaagagagttcagaggcctccttgtccttccctcttcccagcctaggaacttgatgacaaatgctttgtcgtcatggtagatgtttaaaatgtgttcctgttattagccagatacaaaaaattgagttgtggctggacacggtggctcacgcctgtaatctcagcactttgggaggccaaggtaggcaaatcaagaggtcaggtgttcgagaccagcctggccaacatggtgaaaccccatctctactaaaaatacaaaaaattagctgggcgtaatggcgggcgcctgtaatcccagctatttgggaggctgaggcaggagaattgcttgaaccccggaggtggaggttgcagtgagcccaagatcatgccactgcactccagcccaggcgaaagagtgagactgggtctccaaaaaaaaaaaaagaaaaaaaaaagaattggaaagcttgtggggtgctacctcaggaattatagatgctttattacattcagtttaacctgcctgctataggagggatagtgtcagccaagcaaattagagaccatttacaatataagaggtgaattatcagtatatatatatatatatttcttttgctcagcatttctctttttgcagcctaccatctgggtgtgaatttggccaggcagatatgcagaaactggttccaaaggatgagaaggcaggtacgacccagggcggaaaaagatcaggtaactctaagaaactaaaatgttagtcattacttctaagttttgttcctacgtctttataggtttattatgaaaatttttagttagttctatcatccatagtctagttttcatcctctcactaatttttagtcatttcttccataaaaacatatatacataatggtaaaatttagaaaatgtagttgaaagaattacccgtatttctgccaccaaaaaaaaaaaaaaaacattttggaagtgtctgcccgtcttttttctctgaatacatttgccagtgtcttagataaaaacatttcgtagatctctttcttcacttaatgttaggtaccatataaaggtacacgaattaactattccctgttaagtttctaatatgctatttttaaaaaatgaacatttttgtatctacttttctacaaatgtaaaattgattcctagaaattactgtatcagagggtattaacaaatactttttaatgtggctactagaaaatttaaattatatatgtgtttcatgttatatttctatcgacagtgctgttttataaagaagattgcttttatattatctcatgataaaaattccaaattttggccgggctcggtggctcacgcctgtaatcctagcactttgggaggctgaggcgggtggatcacctgaggtcaggagttcagaccagcctgacgaacatggagaaaccctgtctctactgaaaacacaaaaaattagccgggcgtggtggcacatacctataatcccagctactcgggaggctgaggcaggagaatcgcttgaacctgggaggtggaggttgcagtgagccgaaatcgcgccattgcactccagcctgggcaacaagagcgaaacaccgcctcaggaaaaaaaaaaaaaaaaattccaaatttcagtaagtagaaatcatacacaattttctgactctaatgctacaaacctaaaatgaatacaagcaacttttccagaatgttttttctctggtgttcagtatcaatgaggaaataaaaaaggataaactattaagaaagcaatgaagataattctgtgtataaaaatgcatcaggccaggcacagtggctcacgtctctaatcccaacactttgggaggctgaggcaggtgaatcgtttgagcccaggagttcgagacccgcttgggcaacatgacgaaactctatctctacaaaaaaaatacaaaaattagccggccatggtggtacatgcctgtagtcccagctactagggaggctgaggtgggaggatcgcttgagcccaggaagttgaggctatggtgagccatgagtatacccctgcactcaagcctagatgacagagcgagaccctgtctccaaaaaaaaaaaaaggtatcaggcttaaaacttgtacagaaattactagaaagggaaatttctaaggaactaataaagctgacataggcttagaaccaacaaacaaggacttacatatgacagctggttattgtgagggatgggataacattaataaactataaagaaacctgacaaaatgagaatttcaaatttagtcaaaacatactaaatttaactcagggaaagaataaattgactaagaactgagaatgaaattagattcactgtcaaagaattgcctctctaacagatatattttttctagcaatttaacacatttaacaaaaacgactcagcttctccacagtttttctggaatgttaagagaacaacttggtgacttgttttataagtttgcataaagctcattcttagatctaagagcaagcatataccaaagaaaaagacacatgtcacattcatatacataattcttaaatgctaggaaataaaattgtccagtggtaatctgtgatgtctagtttgaacttaacaagctataacattctagtagggcatccacattgacagcattgggtactgtgcacactgtagtccatgtgaatggtaccccctgggttgggctgtgcctacaacagtcttccaaggtagccctgggttaatactattcatatgctgtcatttgaagatgtcagcattaggtacttagaactccagaggagcatatcagtaaaatatttgggtcgtgtttttgtttttcaaatttaggaagccatgggaattgaaagagtaacaaaaaccataggtaatcttgtcagtacttctcaaggaaccaggtaaatgttggctctacattgtcctattgctcccctcttatacatctgtagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcaggtgagtcattctcctttctcctaccttttctggctttcagtcccttagtcttgaaacagattgagttggaaaggctatgttgtttcacctaaggaagtttaaaacttctgtgactcatttttaagtgtcctttgttgagtggctgctatgtgacaggctttgtactagctgctacggatacagacatgacagaatcccttcctgagagccatatctactaccctcccttctttaatttcttcctcctacttactcttcaactattgcatattgttgctgctccttccatttcactgagatgtctcagcaaggcatctacaacgtccttgtcctaagtcccttctcacttgtctgcagcatggtagttgacccaccatctccatctagaaatattcttcctttggtgcttgtgttattaagctatcttgattctcggataactatctggctcttccacctagtcttctctttttgtgttccttgaacataactggcaagagacatagtctgataggtgttttatattaaagtcactttggcagctttattgagactgtattggcagcatacaaaactgcattaatgatttgcactggtctgtttgcccttttttttcccctttaatgtaataccaatgtttgggaacctatttgtgtgttcgtaaattgtcgtcactttctggcaccttaatatagaggaaaatggagacctaacttagaggaatctggggcccttcgtaaaagcaaacagaaaatggcctttggtgtttccatttgttacctcaaattcccattgcattttacattttacttttaattagtttaattctccatttattttaatttgaaagtctaccaacattaccttcaaaggaaaattgaccaagcaagaagatgttcatatttctctctccttgctttgtcatatttctttgatcttggagcattcagaggtttctgtgtgaacccagtccatatactgtttctctttggttactggccttttgccatcctcttgtctttggactacctttaagcactttgctatctgttcacctgaaagcagtggtgagaaagtgtaaacccaatgattggattcattaggttttcaaagtctgggtatacccatatctgtagactattccctaattaggataaagaaatcttaatttggatgtaataggaagaagaaaggactgttttccttgttcctatactgtatacatttgagcttattactaaattttagcaggatatgtaacctaggctcaagtagagcctatttttacacactgagtttatatgtgcatgtatatcctgaaaagacatagatttaacccttgagcaacatgggggttgaggcaactcctccacacagtcagaaatccatgtataacgtttgactccccaaaaacttaactactaatagctatctattgaccagaagccttaccagtaacataaacagtcgatggacacacgttttgtatatgtattatatcctgtattcttaaagtaagctagataaaggaaaatgttaaaatcttcagagaaaaatatatttactattcattaagaggatcatcatagaggtcttcatctgggtggtcttcacattgagtagctgaggaggaggaaggaagtggggggatgttggtcttgctgtctctgagatagcagaggcagaacaggtcaaggaggtagaaggaaaggcaggtatgcatggtgtaactttgtggaaatacacagtactttctttctgacttggttgctttttcatttctctaaaaatgtgtctgtacaataccaatttttcttccaccgtttgctttagtttcggtgcccatatcatagtaaggtccacatcataaaaagtcaaaagtattctttagtaatcagaaccctctgccagattgtcttatgtcactttggttcctggcactgcttctacatcttcttcctcatcatctggtatcggttcagaagcactcatctctatcaagacgtcttctgttacttgctctggtgtggtgtttattagctcttgaatttcactgagattcatatcctgaaattcttcacccatgaccttttttttgctatatccacaaactcgtgatttccttgattggcgctgtcataaatcctgttaagttctgcacaatatcaggacagttttctccaacaggaatttatttcaggcttgatggctttttctgtgacaatgatggcatcttcagtggtgtaatccttccagactttcgtgatgttccctctgtcagggttctcttccacagcattaacaatcctttccttagagtactgtgtgtaatagccttaaagccccttatgactctctgatctagaggctgaattagagatgtggttttggggggcaagtagaccacttcagtgccttttgtgttgaattcatggggctctgggtcaccagaggcattgtctaatgtcaaaagaactttaaaaggcactcccttactagcaaggtacttctgacttcagagacaaaacatcaatggaaccaatccagaaaaggggtcttgttgcccaggccttcttgtacaaccaaaagaccagcagctggtagtttatctttctccttcaaggctcggaagttaggagctatataggtaagggcagtcctgattataaacccagtagcatttgcacaaaatagaggagtgagtctgtcccttcctgccttaaatccttctgctcacttctattccttactaataaacgtcctttgtggcctttttttttttttccttcaaagtagggcacttttgtctgtatgaaaaaccctttcaggcagataccctttctcaatgatgttcttagtggtgtctgggaacttatctgttgcctgttggttggttgtcagaagctgcttctcctattatcttgacattctttaagccaaatctctttctaaaattatcaaattatcctttactggctttacattctccagctttagatccttcactttccttttgctttaagttttcatatagtgagttcattattttcttgaattgcattagaatctatagatttgtctttattatggcaatcctgtacccacataaacgtgcattttcaatatgaaataaaaagatttcacaaaagtgcaaggttttcaagcctgctggtgtagctgcagcaacagcttcactaatttccttttgtttgttttacaatggtctttacactgaattcatttttcctgaagtggtgggcaatctgcaatccatatcaaataattcaactttttcttgaagtgtcatgacttttccctgcttcttgggagcacttccaacgtcactagtgacacttcatatggggtcatagagtgacccaggtttattccaggttttcagtattgcggtaaacatgaaaaacaatgcgagaaccatgagagatcactacacaatttactggagagatgaactgttcatgtagaagtgcttagcctcacacagtgttttaagcagattgtggcaacacttgagctcaccacagtatcagcaggtcgtggctacaaaattattacagagtataatatgtactaaattttatccagttactcaatactgcttatttactgcaaatggcaccgtgtataagtgtatgtgcataagtgtgataaatattaaatttttataatttgtgtatattttatggtagtaaatgataaaatagactagtatctacatatattttatgcgtttatgacatacctaactttttgttaatttttcaatattttgaggctacatgtttcatctgagagttttttcaaattgtcaccaatctccaaaattttcagtatatctattgaaaaaaaattcacacataagtaggcatctatagttgaaaacctgtgttgatcaagcgtcagctgtactttgattcagacctagcccttcttgtctctggatcatgaaataacgtttcatgaaaaaacgtgaaataacgtttatttttaaaatgctatggcaacattttcatttatgattttaaaagtatatttcattgtagaaatataaaaacacatgaaatatttaaagagaagctggaaagcactcagttttttgtgttttcttttacatatgtttatatttgtatgctgccttttccttgttgaattatatattgaaaagcatcctatgaaatggaaaatttgagatgtccataatctgcccaattccttaagaagctacttgtaaaaattttcctgcttttcctagtttattttttcctctgggactacatattttttgttgtgatcagactatgtatattgtcagtgatcttttcttatctaagtggctaatcatttttggcattttaaaagttttctgtaggcattttaagtgactttatcatccactagatatcatttaacttaaatatggtttcaatttatgttcctctagcagtatgagtgcttatttgtcttttacatttggtatctgttgagtgccacatatctgtctcctaccgtcaaaagtggcatttgttccttgtgggacttcctttttggattattgaatgtagaacaaatccaagtgttaactaggggttgtaggaggaagtggtgagtcataaaaatatgttaatggtaatatgtctgttgtaattaaaccattctgagaatactgtacagtcttattctgatttctgggtttcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggtgaagttcagcttgagattcagggactagaaagttacaataaaaaatatgtaagttgttcctatactacttaaaatggagtgtgagccactgaatttgagaatttggaggtcccttgtttactctagaaaatgaagtgtaagttacttgttttggttgtacctagtacagaacatgggtaatattttaagtatttacagtcaaactgcatttcagtggtcttatataggtagtatcccttatccaaaatgcttggggccagaaagtgttttgaattttggaattttttgggttttggaatatttgcggaatacttatcagttgagcatctctaatctgaaatgctcccatgaacatgtactttgagcgtcacgtcagcaatcagaagtttcagattttggaacattttgaattttctgatagggatactcatcctgtattctttagtaggtgggaggtgtcacttcagtgtgtaaattttactcttgccttttacatgaatttcctattgcttctgtctctgctttacagaaggttaaagttttgcctttttttccactttcaggctgacattcttcatctgttcagttggtttcacatccccaatgctgtttgatgagaggaagtatccctaccacctcatgctgcaaaaatttctctgctccggaggccacaatgctctttttgagtaaggatcaagttgcttcacagaggagcatttcttggagtttgatctttgctgtgtgccttcccagcccactgcttttaagtaccctatcttgtaacagtgggatatatagaaatagctattggttgtatccttcagtgttctgggaagtaaccatgtttgtctccatttaccttggagggtaggatttagcctcccctagagttgtgtttgtaagggtctctgctttttctcatgtggcttccagttccaagtatgggtttttaaaataggtttgtctttttctgttgtttctctgaatataatttttctgctattcttggtcagatgatttcaagatgagtttcactggtttaggtttttttgtgttttttttgttttgttttgttttttgttttttttgagatggagtctggctctgtcgcccaggctggagtgcagtggcgcaaactcaactcactgcaaggtccgcctcccgggttcatgccattctcctgtctcagcctcccgagtagctgggactacaggcgcccgccaccacgtccagctaatttttgtatatttagtagagacgaggtttcactgtgttagccaggatggtctcgatctcctgacttcgtgatccacccgcctcagcctcccaaagtgctgggattacaggcgtgagccaccgcgcccagctggtttaggtttttaagactctaaaaagtaacggaggagaggcggaacaaaagaaaaaaatagtatagctgaaaactgttggacagattagacgtaatagctctaagaagagggacgtgtagggccaatatagagattggggaccttttagatgtaaaccccccttgccagggtaaaatactaatattctgtctacttttccttatttgaatttagaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagtgagtattcagtattctaaaatcaaaaggaatttctcatgctaagtcgttcccactctattttgtcctgcttaatgaaataacatgcttatttaagaaccactggatccaactcccagatagggctgccttacgtaagggaatatagaccatttgagaattttccgtgataaacatttgagctgtaaatttcagattggtacttgcattaggccgttcttgcattgctataaagaaatacctgagactgggtaatttataaagaaaagatatttaagtggcccacagttctgcaagctttggaagcatggtgctagcatctgctgggcttctagggaggcctcaggaagttcacagtcatggcggaaggttaagtgggagcttgcatgtcacatggcaggagccaggaggtggagggggtggtacacactaactcactatcatgaagacaacactaaacaatgagggatccacccccatgacccaaacacctccagcattggggattacaattcagcatgagatttgggcagagcaaatattccaaactgtatcactgcttaaggttgagtaaaatgcctcttctctgtgcctccttagacctcctcatgttggccaattattttgttgctggtactagttgtggaaggactgttccataggtctttaacttaatccttctgagctttgaattgaagcaaaatgattttcacacacttttcaaattacttacaggcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacaggtagggtactggcctcacactccagggtccagactttgcacccaatggagtgtgatgcttacggattttctaagctcacataccactgagtccctggtcacattaaccaggagacagtttagatttcctccttctcttagtatttattttttttctcctgaggaaaactggagtatagtcctgatgctctgcacaggtaatactcctttcaagcatgttgatgagtattctcagtagcctcctgctgcctcagtggaggcaaactgtcctcagttactttctggttaacctgtaaagagaatggatattgtgaaccagatttattctccaacaagagctttctgaaaccttagtcacctacaaaacttttgttttcacttgcaaataaaatgtataaggggcattttaaaaattgggaggccagaaagaggagaggggaaaggcatgtaaagtcctgccacttccatctcaaagagcattttaagattttcttcctggagtttgtatgtatgtgtgtcagcttttatgtctggagtcctgttcaaatctgtctactatatacacttgtcccgttttttatcattaaagtaataaatactctcattaccaaatttggaaaatacaagacttttaaaaggcattcgtaattttatcacacaagatagtcattgtctcctttttcagtcagtcttgtgcctaatttttacgtcgttaacatcaaataatacatatacttgtattgctgttatcaagaacttttttttactaattggtcattcttttattgttggatgctaattttcttacagtttgatgttttaacactgtgttgtatagtttccttacgtaccaatccttacatacatctcatgattattgcctggtagtagattaactaggtcagtttttcaggcacttgctctgttaccagtttgttttccagaaagttgggaccaatttatacttctttgtatgagtctcaatcttttaattataataaccctgttaatcataataaccatgcatccccccctaactttcttagaggatgaaatcgagaatcttcttggctccttacccaatgtgtagcttagaatgctatagaagcaccaaacagaaaggattgttcattttacctaattgccctagctcataaatgctctcagcccagatgaagttagaaaaagttatttccatcttgaaaaggttccttccttttaaaaatgtatttggatttccgttatgtgattctgagcccttgcattctttatgtagctcatggacatgggcttcacaagggaacatgcaatggaggcactgttgaacaccagcaccatggagcaggccacagagtaccttttaacccaccctcctccaatcatgggaggagttgttcgggtaagttggctcagaagcagtgattttccaggatattggtttgactgctgaagtcctttttccccttattattctgtcattggtcttcctttctataaactgcttctcattttcagacatgtccatgccagtattttcttttcataataacagaagttttctgtcccccagcaatacaaattactatactttgtttgcacaagaacccccagtcacaaaacaatagaagaggcacacttttctaagatgtagaatagatgatcacactgtaagcctccttcctatacttagttttacgtgtgattttcctcatctgttcttgtttgtagtaaccacataagcctgatagggtttgacttatacaagagcagcattttgaggcccttcctctctctttagcttgagcacaagatgtctgattgcctgtgagttgcagtggtcttgttgggtttctttgttttgagtgtgtatccttactggatattctcttaacactctaggatctcagcatgtctgaagaggaccagatgatgagagcaattgctatgtctctgggacaggatattccaatggatcaaagggcagagtcacctgaggtaactatggaacactgcatcctaaagggcttggcacatgaatcttagtattctgtgaacattctgctagtattgcaaactaattgatagaattcaaatctaaaggaagacatgagaagagtactaattcatcccagctttgccatccattattgagctaccttgtattgacctgaagctttaagggaggcatatgaagcgttaatctttattgtcaaataagagacccaatgtgtactcagtagtgccattaggccgaacttggctgtatatttctaggtgacagttactttaattttccctgctggcacagaatatagaacagtgtctagaaatgattttgcgggaggtagtatagaatgctacaagtgacttgacagtgaaagttgtttgaagcatccctcccttctaccttccctgtcttgccttaaactttgtggctgccacatcctggatgaaagtatcaaccgcttgaggagaaggttgagggtaatcatatggtagagcaaaaacattctcagagtctctcttatctttcctccttcacctctcctgtgtattattcacacttccttccctgcttccaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgagctctcaaggggtcagaagaggggagtatgtgaagtggtttgcctgcctgtgtcaaaacctgatttctgaaaaatcagcatattttcattctacctgatatgggtatattctctatttggattctttcgatctggtaatcctgaaacagtgtgttaactacatcgcacacacaaaaatgtctttagaagggaaaaacaaagctctccttttctacttttctcttaaaatgtctaaaatgtgcctcacccttgagtcaggttcgtcccctggactaatactgaataaatgttttttcctatgtaacagccgcttgaacaactgagtccccatcctgatgaatacttgtgacctgatatttgtcctctttttcttttctctcattatgaaattatgctaattatagaagtgggataagaaaggaattaccttaaatccccacacccagatagccagttaacatttcgattgtatttaagttactggaatcttgttttatgtaatgtttcattctagaagcagggaaagaaattaaaaaagggaaaacttttttctgggctttgtaaaatagaactttaatgcacaagaacacaagtaaaggaaaactggataaaacattttttcacagaaagttttagtgtctattttttaacaataattctgagagagagagataaaatgaaagattgctgatggaagtataagttgatagaacctttttggggttgactgtatgcaccaggaagttttaaaatactcatttcctttaacttagattttaggctgcttatagtctagcctaataaagtaattgtttagtggtgatcctttagtagcatacatcttttgatatagattctaaatccctatggtaaatatgttagatttacctacctttctttagtgaatgtgttggaggcagagggagtattttaaaaggttgagaatattttcagaaacctcatcttgctctgcggttccgtgacttaaccctttttttgcttttctaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggtaagatttagatctttggggccttgtaattcattcatgaaagaattatcaaacacttaacatatatgaggcattgaagacgataaagcgaagaataaggcatgagtcctgcatttcatgagcccagtttctgataggctgaaatgcatataattacgtataaaatacagcattctgtgttagaatgataacagttttatctgggtttaggaaagtcatatgcatcactttggattcatgtgagaagggcttctgagaacaagcattaattgaattgagtcagaattgtgaggtggtagtttaaaaaaaaagtatttaaattactaacagagcttggtcatagaatattttttgctcttctgaggaaacctaactggcagccacatagtagagtagggtatgcaaattggatgtggtcaatattgaggtaatagacattagatgaaatcagattcctctctcttttccttgcctatttagtcagcagattatttgaggcaagagagtggtttgggcaagacctgatccaaccaacgtaggaactaggaggcaattgaccttggacaaatgacttcatttgtggctcattatctttaaaacctgaacttaatgaactgaaccctttacatacagcaaactcaggggataaatccaatataagagtcaaactgtgtaacagctgtcttgggggtttcctttatcatggaagtgataactcttactgtagcactttgtaaatagatacttgtgggaaaggtttcagagtactaaagagagaatcattcatggacccccatctaaaacaaatcacaagtaacagtcttgtattttcttttagtgttttttcctgttcatttaagcaattgggataagactgtatagaaagttttatattctttttgttaagtattatgactattttcccatttgctatatacattagtccatcttttgaatgttctctaatttatttaaataattacctatccttggacatttacttccagtgatttcctgttaaaagtaacactttggtgtagccccagtaagacgaaccattaactgtgtttaattattccattttccttgaaagattataaaatttctctgtaaatctaaagctttacaacttcaacatagactgcacaaccttggtgataaaccatttccatattaagcatatacattagtgccaggcactgggtactttatattaatatatataaaacctcaatcatcacaattattctgcaggtaaaaattatttcctctgacccatgaggaaaccaaagcctagaaaatttaacacatcttagattacacaactggtaaatggtaagaggtaaaatttgaactcaaccaattctattattatttacccttatgttcccctcccctatcccatgctaatctttgttactgagtagaaattggtatctggttgttgttgttttttccctttgatctatcaggagttgaagctaccttgtgcttgggtggttgaatcaagtggcatccttaatgtcctaatcaaactcttggaagtggttcagccctgcctccaggcagccaaggagcagaaggaagtccagaccccaaagtgagtaaccctatatctaccctagtttcgtttctatttccctgggacatgggcctgaatcaggcactcttctggggcatgtatggggcaaatttgtggtacttctgtagttttaaaattataaaggaagcatctgatgaaattaagatatattttcccaatttgtgcaggtttcttgctttcccaaaacagatcatttttcttttttaggtggatcacaccagtgttgctcctgattgatttctatgaaaagacagccatctcctcaaaaaggagagcccagatgactaaggtgtgtaatgtagtatgtatgactgcaggacggtttagcttcctgaggcaagagtagaccagaagagaatatgagagagtagtgaagaatatagaagtctctgaccaatgtataaatctcttaagggattttcatagctaggtttctcttctgaataatttactctggaagtaaattttgaaggagtgtgctatctccagaggaggagcggcttttctgttatgtaagggactgagtatacagcaatcctaccaaaaagcaaacactccttagatgaagattattgtgccacatcatctcactaccttcttggaaacagaatttttgtttcagtacatctcaggtgaacattccccttttagggaaaatcagtagaaacaaaaggaaagtagaaaatggcaagataaggggctgtagatagtttttttgtctaggaaaagtatcttagtccgttttgctgttgctataacgtaataccacggactaatttataaaccataggctgggcactgtaggctcacgtctgtaatcccagcactttgggaggctgagacaggtagattacttgagttcaggagttcaagaccagcttgggcaacacatggtgaaaccccatctctccaaaaaatacaaaaattaaccaggcatagtggtgtgtgcctatggtcccagctactcaggtggctgaggtggggagatcacttgagcctgggaggcagaggttgcagtgaaccgagccggcatcgcgtcactgcactccagcctaggtgacagagtcagaccctgtctccaaaaaaaatatttaatataaactgtacaagtttatttggctcatagttctagaggctgatctaagggaccacatctggtgacagccttagtgctgcatccttctattgcagaaggtggaagagcaagaggtgtccaaactcgcttttataaccaacccagtcacaataactaacccagtccgtggataatgacattaatccattcatgaggggcggagtccccatgacctaatattatcttttattaggccccacctcccagcactgttaaattagggattaagttttcaacacctgaactttagaagacatgtttttaagcgtgtagcagagagactaaggaatgtgagagtaaatgcatatgaaaaatgttcttttggtttttaaaatttattgtccagtatatttctttttcctgggtgagttttagcagtgaacactgatgaagttactatttcttctaatcaaccttgaaagaaatacaaagaaactttgtacttttatgtttagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggtacatgctcactcaccaagcttgtctaacccgtggaccacaggccacatatggctcaggatgtctttgaatgcagcccaacaccacacattgaggtttttttgtcgttgttctttttagcttatcaaatatcgttagtgtagtttatgtgtggcccaagacaattcttcttccagtgtggtccagggaagccaaaagattggacacccctactgtaaactttatcaaaaagaggggtatgtgttttggttttcttctttctgaaccagcattcctaacgtgttaggaggaggagagttaccattacctaattaagtatagatttcagaaaatcgagtcttcctaaggtcattgattagaccttgggtctgtagcaatttgatactatccctcttagaaatgattttaagtgtttagtcaagggctagggagtggttagggatggtatttgctctgttggaaggtctacagttcattataaggccttgtgtatgccacttgccttctggggactttcaggttttttctctgtaaatgataaaggtgggataaattgccagagttccttcctgttgtagcattttacctgggagatgtccctcccctcccccacctttataattcatttttggtagaggtttttttaatgtctgtttgaattcctaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatggtatgtaccaagagtgttttacctaaagctaatgtgcctttgtggcttaaggtctggccaatttcattgtgagttattttcatcagcttgattaacagattaaagatacgtaggcctcccttatgctttttcatctgatcttaaaattggtatttggcatgcttctcttaataggacccaagtgcttggccaattacttaggagggaggcgtgggaggaaataaacatcaagttaaactgtctaaaactgttattttcccattttatagatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggtgagtgtgttttgtatcagattctggtttagctttacatcatacctatgttctccttggtctgagaacaaatagacttctggttcttcttagggtatatagctagatatgtatactgtatactccacccaacagaattttccaactctatgcttgggagcttgcttaggtatggtaggatgatcctattgctagaaagtcctctccagcaatctggttttcttttttttctttttttctttttttttttttaatctaggtttcattaaccaagccaaaaaccgttagtaaagaactgggataccttcccccaagttcataccttcagaatcattcctttgtaggagtacctctcgggtgttcagccaagagactattctcaaaacactgtattttggaatataaaagtatagttaaagctttttgaatgtttgtaatctgccaggcactgtgatagacacttaacaaatatccattgtgcagatcagaaaacaggttattatattttaggaaacttacaaaccagtggaagaaatagcaacgtacttataaaaaataaaaacatttgtaaagttaagacaatagtctgggtgtggtggctcatgcctctaatcccagcactttgggaggcaggtaaatcacctgaggttagaagttcaagactaggtgggtgtggtggcatgcacctgtaatcccagctacttgggaggcagaggttgcagtgagccgagatggtgccattgctccccagcctgggtgacagagcgagactctgtctcaaaagaaaaaaaaaaagaagacaacagtggagggttgaggggcaaatgtcctagtagtgaggcttttcctcctcagtacttaatacaaaatcctttcttctgctgattctttgtcatcaataatgactgttaatagactttgcttccgttttcctctcttgggacattgtttcccacatttataagcagtgttgcaatatgcgtttttgtgcctaactttgttcatgtttaagatcgttacttagagatttttagtaattggatcaaaaggcattacaagtattttttaacttgcttgccagaaaagtggtatcagtttttgtatatctgagtatacattttagattcttcagacagttctttacacagcctgcttgatttcacctcacatgtgccaaatcaagagaaagagagctgttaaaggtagcttgtatggtgatccacagtccaggagataacccagcagggaaggaacaactatatacaactaaattctgattttagaaacttgaaatgcttgaaacgctttctataaagaaatgtttaaaagttacaagttcaaagtgctaggagaaagtgtaggtcctcattggatgagggaaaacttttaaagttttaactttaggtaaattatagttggggtgtgggaaacaaaggaacatcagtgacagtcttaacgtatcaagatggcaaaatgtaaagtcttggtactattcattgctagtacaggtgtggaaaaccaggcatactcttaactttcggtaggagtggaaattggtgtagccacatgggagggcaatttggtactcttggtctaagatatcctttgacctagaaattctatggctaagaatttatctgataactaacatcaagtataccaagatgcatatataagagtgttcactgtggaattgcttgtaatatcaagaaactagaggtctaatgtccagcagttgggggctggataaattatggcttatccttaatattgaaattaaacttttctgtgtttattaaatggaaattattttataattacagccagacaggcaagatacagagggtataatgtgctaaagggcatgattgatttggtttaaaaaaaaaaaattaagataccaaaagatgtttttcattgtgagcatgtagtttgtgaaataacagataatggaaaataatacaattgagttattttcttcgtgctttcatggatttttccattattaacaagcaattttatgagaagagcagaagcatagctatatgtaagccctgtgttatcaaggcaaacaatatataaatagttcagtatctccagtggctatcattatctcagactgatggttgactttgaggcataaagaaaatatttaattgtgttcctgtacactaagtggattacagtgttacatgtttttgaaccattctggtttaaaattgtgacagcatttggagaggctcaggagctgacattttaatgtggaagttatgtggggtttatagtcttgacacatctcccagtttctataaagatcacatgcagtctggtctaataattgatagttttgagacatgctgcaacttttttataagccaggttttttgaatcaagaagggatgggacgggacttaaaaataaaatgtcattctccccaaaatcaaaagcttttagtcttggtaactcttgactgcagttgtatttttagaaagtagtgtttaatcgacagtgtttctttctctctttactaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactggtaagtttcgcttgctcctggcctttgatattaagtttgtggcctggtataaatccagaaatttatttatgaggaggtctgtaacttgaagagcctccttaggcaagtattaggacatttgctggctaattgattgtttgggtcaatttattaggtacttcagtagcttctctgggccttgccctgttgtaatccctgccagagacactgaggactcattcattctagtccttcacttcaaagagctcattttggtggggcagtaggctttacatatagttaatggtttacaaatcaagtgataattaagggttaaatggatgtatgtctcgtgtaacacagtgcgaaatagacgtcatctgtgtattcctgccaagaaatgtttgacctgtatttaattatgaggaaacaattagataaatacaaattgtgagatgttctatataagacaactggcctagactcttcaaaaatattaatgttatgaaagaaaaaatacaggatcatttcttatagagaaaagtagactagagagataatcaccaccagccttggttgggctgtggatccagataaaagatttggagaaatttgagtgctatgtattaggtaatgtaattgtatctgttaaatttggggggtattataatggtattgcagttctgtataaaaatacccttgatctcccctctgctgacttttttggtaataaaaaagaaaatatatgtccttgatcttaggagctacaagtagatgtatttaggagtagtcacttggtaattctggatgaaaagtatatagatgtttattatactattcgaacttttctgtaggtttgttggatttgtttttttattttattttttttttttaattttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttccatccacacagacccggcaaccatccgatttctcaatttcttccccacccttcccgcctttctattccacaaaaccgccattgtcatcatggcccatccccaatgagccactgggcacacctcccagacggggtcgtggccgggcagaggggctccccacttcccagtaggggcggccgggcagaagtgcccctcacctcccggatggggcggctggccgggcggggggctgacccccccaccaccctcccggacggggcggctggccaggcagaggggctcctcacttcccagtaggggcggccgggcagaggcgcccctcacctcctggatagggcggctggccgggcgggggctgaccccccccacctccctcccggacggggcggctggccgggcagaggggtcctcacttcccagtaggggcggccgggcagaggcgcccctcacctcccagacggggcggctggccgggcggagggctgacccccccacctccctcccggacggggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgaccccccacctccctcccggactgggcggctggccgggcggggggctgacccccccccacctccctcccagacggggcggctggccgggcagaggggtcctcacttcccagtaggggcggccgggcagaggcgcccctcacctcccggacggggcggctggccaggcggggggctgatccccccacctccctcccggatggggcggctggccgggcggggggctgactcccccacctccctcccggacggggcggctggccgggcagggggctgaccccccctcccccctcccggacggggcggctggccgggcggggggctgaccccccacctccctcccggactgggcggctggccgggccgggggctgacccccccacctccctcctggacggggcgactggccgggcagaggggctcctcacttcccagtaggggcggccgggcagaggagcccctcacctcccggacggggcggctggccgggcggggggctgacccccccccacctccctcccagacggggtggctgccgggcggagacgctcctcacttcccagacggggtggctgccggacggaggggctcctcacttctcagacggggcggcggccgggcagagacgctcctcacctcccagacagggttgcggcccagcagaggcgctcctcacatcccagacagggcggcggggcagaggtgctccccacatctcagacgatgggcggccgggcagagatgctcctcacttcctagatgggatggcggcggggaagaggcgctcctcccttcctagatgggatggcggccgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcgcctcgggaggccgaggctggcggatcactcgcggttaggagctggagaccagcccggccaacacagcaaaaccccgtctccaccaaaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccatggaaggagaccgtggggagagggagggagagggagagggagagggagaggagggagaggagggagagggagtttttttttttttttttttaataaaacgttgggaaggggatgaaattattttggaagttccagctatgtgcctgcccctgtgctgggcatttctcagttatatcctcatttaatcctcaacataaatttggagagtgagaaaattgaggtttgttgaattaacaactggatttcaaaaccagttttctctaactcaagcctttactatttggtactgctatattaaatcctgtggaatttaaggaaagtataaaccaggttttatagtagagtacttgaacattaattgaaaatggtctcctatctcaagccttctatatcatacatgcccccttctgagtctttattagtaacctagtttaggtactgcttcatgattgactggtttttctctctcattttggcttagcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaaggtatgtggctagcctacctcaggaggctgggcactagaggatatgttactttgcctgggtcatttcagccaactcatggcttagtgagcactcactatgtgcccatactctggggctcaagatgaataagatacccattgcatgtctgtgaagaagctaatagtcatatagtatgacataccaggatggtggtaagtccttagggtgaggcaccttacctagtgagggtgcacaggtaagaaaatttctttgtgtacatgatttctaaaatgaaccttgaatggatgagattgccagagttctgttatatgagaatacacaccatacgggggaagaatgaacaaagatttagaaggagataatagcattctgtgagaggttgaaaataagacaccaggaagtctctaatgttttcatactcaagcaaaacctttttattgtctgaagagctggaggcaatattaggaggtgtgtctgagtttcctaactgttgagaccaccacacccatccacctttattcctagttaaggtgcatcttataagcattaggaaagtcatgattgatttgcttggaacataggtttccattatagtaaggtccttctggattttattcaggacatacttatttgataggtccacagaattgccaaaaattgatgaatgctgcctttaataagcaaaagaaatctgagtcttgaccttggtgcttttcatctgtacagaaccctgatccatatagaattccttggttctcctatcaccccagaatctttaccctatctcttatcacctccccgaaatagtttagctatatagctgtggcaaccatttattgacccaccactgcatgagcaatagtgccaggtatgttcacttaaggtttgtagttacagcttaggaaagtgagactaagttaattgcctgtggtcacaagactagtttttgtaattttagggtgaggcactctaacattatctgtaatagcaccatgtaaacagtcatagccacttgatgtgaaattgaccaagactgactagataggccttaacattgtccaattgtagaagaggtttattttgtttttgatggttgttactgttttcctagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatgtaagtcaattccaacagcgttttatctttcttctcatttttcaatgcctgtgtggtctcagtatttagggctatccccggggaatttcaaagatattaattgtgatgtatctgtaaattatctgttgcctgtaaagacaaaattggggtgtccctggagacttttttttctctcctaggattagaactgttctttaattttttttcttttccctttccttccccgcctcccccacagtctcccagtcactgtatttataatagcctcccacagattatagtataaaggtgtaaggtggttaaaaggttggccaaagagaatctgtggcattcccagccagtgccctgggaaggagttctgccatttgcagacgggtgcttttgaaattcataatagctcaggagttttcttcttcttcagagtcaggtctttgctgcagatggtgcctccactgagacttccgcatctgggacctcccaaggagagggtaatgatttgcttttctcactaccatgttcttattccttaggaaaacaacttgaaaaaactgtaggtgtcctgtgcagggggtaggagaatacagacttaattattacgtttactggtctaagtgaactttctcaggtgagctcagtgttctgtaataaagggtctctatatgctaaagttaatggaactgtaagttaaccaacctagtaatggttgctgtggtaacatattttagttttactttttaaatcacaccataattatttggggggtttctaaaaactggcttatagagattttatgccagtgatattgttctagctacatgctttacgtggtggatgcctgtcttccagcaatgttaacagagcccattgactactcaccatgaactagaaaaatgtccctgggagtaagtctaatgagacctttaaagagctgcttctccttagataggaaaggtctttgtgatccaatttaggagacattttgtttaaaatcatactagttcctggagataaatttaaaaggctaacattagtgaaataattggttaactcattttactgggtttactggccatatgtagtgtatagcgtggatgatggtgctgattcaagggaagcattacccactatgtggcagactatattggacaccaaaatggatcagatttgttccctgtacttaaagtactttgtccagtgactgagacctgcaagagttataatgcaggataactgccagaatgaaggcatacttggataagatataatggacatgtaaagtatctcacagtatgtctagatgagacaggaaagcatttatggaggaggtcagcatttgagctgaactagataaaagtgtgccaggcagacggaagaaagaagtaagggagcaagacaagtttgaagaactgttagtagagtgtttctggagtatgtaaaaggagggaaatggagggagatgcacaaatagttggacaaagcatccctgttgtactgtaaccacataaatctgagacctgagttatcctggttctctgctcttgcactgcagtgtcacgagagcattcagtttgtacaggtggcttaaagtggaggagaaatagcattcttttccacctaagacttgattttgccagtgttccagtgtggaattgaaccagtgtttgacttttctcaacagcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggtaatatttccaacttctatttaagatgttacactgtacttccatcatttgggtaccgcctgtgtcagacactgctgggaagctgtgcatgctaagtgctaacccaagtaatgagtgagaagaggcatcttcagacatgcaaggccgggtgcggtggctcacgcctgtaatcccagcactttgggaggctgaagcaggcggatcacctgaggttaggagttcgagatcagcctggccaacatggcaaaaccccatctctactcaaaatacaaaaagaaattagccaggcgtggtggcgggcacctgtaattccagctattcgggaggctgaggcaagggaatcacttgaacccaggaggcagagattgcgggaatcacttgaacccaggaggcagagattgcgggaatcacttgaacccaggaggcaaagattgcagtgagccaagatcgcaccatcgtacacctgcctgggtgataagagcaaaactctgtctcaaaaaaaacctgaaagagctaggccttttttcattaggttcactgagagagagagttaatgagatttgttctattgaaagtccctttttatgcattgtggagattgaagagggaagactggagtcagagagaacagttaggaatctgatagagtaatctagtaacgtacgatcttggtgaagttggaggaaaatgggtgagttgaagaaatatttttaaggtacaaatggacaagaattgggtttggaagatgaaaaaggaaattaagactcaaggatgtttcttgatttgtgggggtttttttaattgcttttatgggttggcatctaacaagaaaatagaatggggtggggaaggtttgaagagaaaatgaggagttttgagaagtatctgtgggacatctaagtaaaagtgtctaaaggacagttgaataaaccatataaataagaatataggtgttcatcttccagatgtactcacacatgtgcaaagacaccagatgtggtagcagtattggtaataaaaataaaggaaaagccttaaatgttcattagtagagctgtggaaaagaatgaagtgtcctgatgcagaattatcctcaggttagattttttaagtgagtggggcattttgagaaactgtatcacatgttcccgcatatgtaaaatgggtgcccaaatattttttcccgtaagggtgccttgttttgtggatcacattgtaattttatggttagtaagtggcaaaagggtctgagagtgagtaggggcactagtgttgccatctttgaaagcaaccgccatttttaaagctattcttactttaatccaagtttaatatacatagaaaaatacacaaatcttaaatagtctgtttttcctaggtaaccactagccaagttaaataaagcattacaagctccctagaagctgccctccttgttctttagtgcatctcctcccacccatttcaccttcactcaagataaccattatcttgagttctcgtgccgtaatttggttttgtagttcatgtaaatggaatctcatagaatgtactctcttttttgcctggcttcttttgcttaacatacttgattcattttgtgtgcaggtgaagtttattttcatctgtataaaattccactgtggaatgtaccatgtaccaaaacaaatacatcttttacccattctactgctaataaacatttgggtaattttgcctttggagctatcacagatagtgctgctatgagcattcttatgaatatatataagttcgtgaactacccaatttctgttgggtagtatatgcctaagagtaagaattgctgagctctagagtatgatagttgttctgctaatgctaaaagttttccagagtggccaggtcagtttatattattaccagcagcatatgggagatcaacagttggtgttttttcattttactgattttaatgggtttgtagtggtattgcattatagttaaaatttacatttccctgttgaccatttttttcatgtctttattggccatttgttcattctcttttgggaaatgtctattcagctcttttactctattttcctattgagtttttaaaatatattctggacataagtcctataaatacataaataggcttcctttttttaagagtctcactttgtctcccaggctagaatgcagtggtacaatcatagctcactgcagctttgaactcccaggctcaagtgatcctcccaccttagcctctcaagtagctgggacctataggcacatgctaccacgcccagctaattttattttttgaggtcttgctatattgcccaggctggtctcaaacttctggcctcaagtgatcctcccgcctcagcctcccaaaatgctaggattacaggcatgagccatcacacctagccaggctttattccaaagctttaactcatttatgccagttgtattcataatttataatagtattacctgtgggttaacatatttaattacaaatttattaagtatctgcctaatatgtgtccagtgtcctaccagtactgggtactggtaagtgctttataaatactattgttaatcctcacctccacactgcaaggttgttgatagtgatctctttaatagaggagagaaggctcaaagaggtaagtaacttgcctgggaccatactacagagtagcagagctaaaattggaagctagggctatgattccaaagctaagtcctttctacgtggttattgagaaaatagttttaactttgtatgtattcactactgggaaattaattgttatttctaattgttttgttttgacaaggtcactttattcagtttctcagactctcaaattattcaatgcattttctttattgaggtaaaatttatataaagtcaaccattttaaagtgtactgttgagtggcatttagtacattcgcagtgttgtgcaactgtcacctatgtagttccaaaaatgttcagtgtattttcatccaaaatttgcttgaatgacaatagaatttgtttctaagataaggaattgtctaggcaggaattgtagttagagaaaaaagaagagtctgacttaatttccttcctctattgagcctttttcgttactttaaataaccttgcattaaatatttttgcatattagtttctgtgactctgctgtctcttgctcagctcttaccagcttctattgtagcacagggtcctgggcacattgtaggtgtcagtaaataatttcaatttaattgaacactgaagggtttatagcacttaattaagaatcaaggtttgaatcctcagcccttgattaaattcttctgtgcaagccacttctttagggggcttcagattaccgcttatcaaatgagaaaatacttatctatttatagatttgctgtaagtagttctattaaatatcacatgtgaaaatattttaagataggtgcaatagcacatgcctgtagtctcagctacttggaaggctgaggtgtgagaacacacacacaggagtttgagactgtggtgtgcgatgatcatgcctgtgaatagccactgtactctggcctgggcaatatagcaagacctcatcttcttaaaaacattttaataaaaataaagtttttaaaaaatgtttttaaaaatacatgacatctacataacagtgtataagctgtgcagtgggaaatgggtggcatttggaagttttctaaaatctgggtttgctccttacttgcttgtatctttgagccttggcttcttcatctataaagtggacctaataatcactcattgggtgacttaaggaaatactatgtgtgtgtgtatctttggtcctgtgcaaatgatatggcataattgtgcttgtaagtaaatgtcgtgattcatgacttttcaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggtaagattcatacctgtcccagggctaatagccaagaacatccccttattcttcttcttagtccatgggtggttttgcacttgaacaaaacttcttgtcatactggcatcatatactctctggtccgctcaaatagttctggcggttggaaatagccagagcactgattaccattagagtaagtgggtaaacctagagaaaacaaagggaaatgttaagtgtacttttaaggtcttcaaggaagttgagcaggttatttgatcttatattttaaattttatttaaagtaggggctgggcacggtggctcacgtctgtaatcccagcgctttgggaggccaaggccggtggattgcctgagcccaggagtaggagttgaagaccagccttggcaacatggcgaaaccctgtctctacagaaaattagctgggcgtagtggcacgctcccgtagtcccagctactcgggaggctgaggtgggagtgtcacttcagcccaggaaggttgcagtgagccaagattgcgccactgtactccaccctgctacagagtgagaccctgtctaaaaaagagaaaacgaatgctatcaccttagggagtgtgttctcacctgtttgtttagatgttatttccagaaggaaatacaaaagttacaggagggttatctgaggctattttgtgaagacttggcctgagaaatggctatattcatatgatagagatgtcaaaacttctctcccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccaggtaaaatcatgccccagccccaggcttttccttctcttcagcctcactacacgaatgatgtggaggtagctggtgtagtgggaaaactttgggtacaagtgggagacccaagtctttcttattgtggcttttagcacttgtctttcttaaagccttggttcttacttgctataaactcaagagttgaactataatagtgatttttttttcaagcttccccccactttaaaaattaccacttattagaagattatatgtatattataagaaatacagatgagtaaaaataagaagtagacactgtattcctaccacccagataccatgattaccttattggtttattattcagtgtttttctttgcatgcataaataatgtattctttactaacatgatatgatacatgctattgtgttgggggaaatttggggcattttcgtttttattttcagttactggtcacttccttgctatgaaaataagtttcatcctacctaatgcccaaatccataattaagcatttttctccaaaccagaatccaattaaggacttgtattacatctggctatgttttctgaatctctcttattctaaaacaattttttttcattatttcgatctttattttgtttttgttgttcatgattccagcttgttgaagcgaccgtgtttttgccttctaaacttggtgcagttgcttccttgcagtgtagtttaacttaatcctttacttcctgatattttctgtaaacttctagttagatctagaggctttagaggcttattgaagcagtttaaacattttgggctgaaatgtgtagcctaggtgatgtatagctcatattgtatcgtgggagacacatctcccatgataattgtcactttttgttcttactagaaagtcatctctgttgttattttggcactttacaaatgtctacactatcaatcatatacctaaataatagccttaacatcagttgataattcttgcctggatcaattaatttctttgaggcttatgaataaaagctttctaatttctcatttcgaatacattattaactggcatttttctgtgttagcctcacagggaatgtctggttgtgctaaaatataatttctattataaaggcagtataaaaacttaatttctttctatttacatttgagattcaaatgtaggtttttttctggctttctatttttaagtcgtattatggactcgacttttcatgtttgttttgttttgaaactagtgattgaatttatttggatcactgcagtcactttttcatgctcaaattattacacctttgacctatgtggccccttcaagatgactaaattgtccttttgctacaaacctatcaattttttgaaacatttataaatgtcaaactcacagtactgtaatgaacaccatgtgtctacctagattaaccactgctgaacattttgctttatttcttcccttcctgtcctttcaggagctgaatcatttgaaattagttgaaaacactgtaaaactttacctctaagtacttgatcatctgtctcctaagaacaaatattcctttatatgggtacagttccattgtcatatccaaaaaatttaccaataatataataatactaaatttatacaattttatatacacatactcccagttatttcaattatgtctttatactctgagggagagtgttttgatccgggattcagtgagtatcacatgttgcatttggttgtcacattttttttttttatgacattttcctgttttgatgaatccaggcttgatgtcttatagaacatctcacagtctacattgatgtaattgctcccttaatggttagggtcaggttaaacatttttggcaaaaatactacatgggtgatatttgcccttctcacatcacgtcaggagacaggtgaataccacttggtcccaatacttgtgatgctaaatttgatcacagccgaggctggtggatcacttgagcctaggagttcgaggccaacctgggcaacatagtgggaccctgtctctgcaaaaaaatacaataattagctggacatgtacgcctgtagtcccagctttttgggaggctgaggtgggagggtggtttctgttagatttccactttgtaatgaataattccattactatcattattctttctgatactcagctgggcctgtggtaatgatcccattaattttttttccccatttttgttgttatttttcctctttatagaaacaggatctcactatgttgctcaggctaggctcaagcaatcctcccatctcagcctcccacagtgctgggattacaggtgtgagccatcacgcccagctgtcccattaatttttgaaagctttttggcacaatgagatatcccaggcttaccttatcccttccttgccctattcctgggatcacttgttctgacgagtcttggttacttttagtgtgatgtgatatcagagactgccatcttggtactactagtgagcatatatatatatatatatatatatatatatacacacacacacacacatacatacatacatacatacatacatagactcacacataaatacacacataaagcagataaaagcagagctgctctggtgttagtgggcacctggttggtctcacacaccttattacacttagaaatcataccacacctccaactgcagcccctattgtacttttattgaactctaggaagccctacagagtataatttgaaattcacaggacttcaaactgttatcagccgggcgaggagggcaggttgcctgagctcacgagttcgagatcagcatgagcaacatggcgaaaccccatctctacaaaaaatagaaaaattagctgggcatggtggctcacgcctgtagtcccagcgacttggaaacctgaggtgggaggatcacttgagcctgggaggtggaggttacagtgagctgagattgtgccaatgtactccagcctgggtgacacagcgagaccctgtctccaaaaaaaaaaaaggaaaacttttatcatgttccttcctttgagcttttagggtttggggactaaatgctggtggtttaaaaaaaaaaatcctgagtacatccgagaagtggcttgcttgcatgtggtcatccagaatacattctgatttccagtcaagaatttgttactcatgtgctttccatggccccatgaaatatggcattgatttaactcttgcttttagggtgggttccttgaagacatttaagtcaaaattttttttttctaaacaaaagtagagtgttagttgtacgaccttatgccccttttctcttagtagattccattgtaagaagcttagtgtcatttagaagatagacacctagtatttctgtgctcagtccatctctttatcttcccttatctcagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggtagggaatcagagccaatggactggagaggtgggagtagttgctttatgggcctgggatcacaactgttctggcttggtggtgtttccctgggaacttgctggccttccagagatctgtcatagtggcgtgggaatctgccccacaaagaattccttcaaaatgcagccttgtttggctatcctcacacgtagccttgtcttttcctttgtcacccattcgtttattctctgagaacttacaaacttgcccaaggaagggaccttattgtctttgcgcttgcctcatggtgcccagcacataggcactctttgattattttgctggttggttgattgtttcaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggtagggaggcagatcacccagcatttccctgttgcggcgctgaaccaaacccttgccaggtggtgtgggtgggtgagtactttagatccttgcctcaatgctggctgctttgcagaggagcatgggtgatatgcttagtagatgctcagtaaatgtgtttgtactgtattaaaagaggggtgggggcagggccaggatgccatgtactatgaaatgatatagatcccaaccagaaaacttaggcacaggtgaaatgttgaagtagaaagctgacctgagaccgttgggccccgggtctttgatttactttggctctggtcattattggaagctccttaacaccaccttatgcctatagcaccagctcttgctggggcattaaaacagcagtcttctaaagaccctaaaggaaagcattgtaatttctggagctggtagcattgggtaagaaattgggcctgtggtcctaagctgctggctttaaagagatctattatgtcttcctggacagtataaagacaacccagtatcagataactgggatggacccatttgaaggatagtctggttgtggattggtagcacgtggtagtttctgtgctaattagcaccgaatgtgtggtttcacgtaacatcctctgtcacatgttatcctagaaatgtatgctgctttgctggccttttttagggtttcggtgctagcacaatgatagacttgtgtgcatccatatatatgttctatttctctccaggttgagaatgagctggaggacctgatagatgagttgcttgagagggatggcggatctgggaacagtacaattataggtgagagccccagaactgagtatagcctcttcctttgcctcagtctctcttgggaggaccctttttctcatcatctgcttgctcagctctgcctaagggctcatagccagcctagatcgctgcttgtcttgatgttgacggtcttacagatgagaaattcacaagacgtctacaggcctgtggcagtctaaagtgttgcctgtgtgggggaggtggtgggagtggccattgatacagatgatacatcaagcacatcaaaagagtgtttattcatggaggcctagaggaggctgtagggtgagaaagcgctgcctttcagttcttcaatgaagtccaggggctttctgcccctgagtctcagtagtgtaaaaagaatgatcattccctgagggtggccctttataaatctcagagggaaaatggcaaaggtaccctactgtcacctggctctgagggtgtatgtgttacttgtttttactttgttgatcaaggaaatcaaaggataaatggaagtagacacgtattcttaagttttacaaagcttttttatacccagtatcctctgtggtttcacaattagtgggattggcagggcagatgtgatcatcctgttttacagatgaggaaactgagactcagacaggtaaagtgactggccaagctcacctagctagctgacagcagacaatccaggtcttctccctcatccaaaaaaaagtggatatctgctaggtgtacatagctactttagacgcacccagtctggaaagggaagtcctctgttgttcagtgaaggctctgctctgtaaccttcagtgagcagaagtggagaggatgaatcacaagaggacgtgctgatggatgaagctccttccaacctcagccaagcttccaccttgcaggccaaccgagaaggtgagagtgccgaggccagaaaggcctcccttcttgccctgcacgtctgacagacactacactagggttttcctggaggcagctgcccacatgtgcagaataaggaagcatctgtctgcatgcgctgacatacaccatccactttatcctcagccagtttttcaaataacatgttactactgcttgcccaaagtttgtcacttcttacttggttcgctttcttctcacccacctgctatcatcgctccaggttccctcttgccaacaggatatagtcaatagcaaagtagggctgaaaaggcaagggggcaccagcagacttggccaagtcctagaccatggctcctcaagcaccaccctctagccagcctccacattcagccaccctgctcagtgtgttgatgcattgattggcactctcaggaaatcgggtctggctcactaagtctgtacatcaccccagatctggttcttcctctcatagagtcagatatcccatcaccttcccactcagcctgctggcctgcacagtagcctgttttctagctactcagtttagtcctccaatgtgctccctttgttttagattccatgaatatcctggaccctgaggatgaggaggagcacactcaggaagaggacagcagtggcagtaacgaggatgaggatgatagtcaggatgaagaggaggaggaggaggaagatgaggaagatgatcaggtgaggggggactgcgtttgggttggttcagatgacctcttccatgggaacatagagctgcagaaaaccaacagtctgggttgctagcctcagcgtctccctccctcatgtgcacatgtggccatggcaccaggcttcagaaaacccttacctccagcaattctccatctcctattttcccttaaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctagtaagatacaggggctcagctgggtttttctctcttgattcttatacccttctctagggtaagccaagcagtggaccaaaccgatccgatacagacagcacttcttttcctatgctgacttcctggggcaagggatatctgaatccatctgtctcattagtgtatacttaggagaaggaatagtgagaggctgcttttgttcccttcacctcagtaaataggcagccattttagagcctggacaacttgatgatttgcttgattaaaaaaaagaaagagaccaaggctgactgcatcaggcacccatgtgcacaccacagtggcagggcaatcaataatccttatgtccataacacaagatcttgagggtttgaatggtcacctttgagcttggctttggggagcagatttgaacatactcactctattcatccaggatgcgtcttttcgggagaacgagtgaatctcttcctcccccatcaccgtgaaacttcccttttagcgtcaagttagaatcgagttcttagaatcaagctgtcttgatagggcaggtcttgacaacttaaatcacaagcatgatgtagcagaaaacactgaactgttctggtctgttttcttggccaattaatctcttacctctttgagcctcagtttgtcacctgtaaatgaaaagttcgagaaaaaaatgggttggattagataactttgaagataacatctatgattattttgcatttttgtgattttcatcagtttcccttagagttgagcctctgtccattcagcaaattgaacaatatttgaggagtgcctactgtatcctaggtactagggatacagcagtaaagaagaaaacagtcctcgttcctcataggagtggtttattaggaatcataactaagcaggcattacattgcactatagtaagagagcacagaggtaaagagttacctaacccaatctgtggaagtcaggcttcacagagaaagtgacatcttaggccaagaagagaagagcaggtaaagaagcgggagaggagtcttcaaggtgaagggagcagcatgtatctgaggggcctagaagcatcactgtgactgtagtgtggaaaatggattgggagaaggtactatttaggaggccgttgcagtatctaagtgagagatgatggcataagctatggtagtgtcagtgattgtagatgagttgtgggaatgagggagaaaggacaaagctcaggtttccgtgtgaggaagtaaggcccaggagacatgattctgcttgaacaaacatggaagaaatttctttttgacactgacccttttacatattgtccttgcagcagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggtgagttacagagatctgttggattcatcggagctcttgtaagaattttcactgtgctttagcattgtcttaaccttgggggaaatagtccatcacttaatgttcttgtcatacacacaaataaggtatttgttccatttctttgtggattacatgtgtagccttttggggagtgcagccttttggggaataccaaattatgtcaatagttctgcgcatgtatttagcaattattaagtgtctcatgccaagcacttaacactttagatatagacgggacaagatccctgccctcaggcttagagtttagtgagacaaacaatcttaagaagtaaaagaaaggcatataagtgttgtaatggttggtgtacagacgacagagagggtgtagtggaggcaatgtgacctgacgcagtgcctggcacgtgggagcttattgacacccacttggtgccaggaactatggaataatatacaacttaagtacaaaaccagggtggtattcagaaaaataacttagacttgtgtgcacatcatcaggtttataatcatgttctgcatttaatagaggatgcatgaagaggatctcatggtaacaggttgcagggcacctctggacttaacagtgatcatggtacccaccattaccctacaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggcaagtttgtgtggtgaaagggagggtagaatttgtcagattctactttttccctgctgaggaaaagcaagacagtgtctgccctatagaaaacccccattttataggagccagaaccactcagtgacttagccatgggcaacaaaaactttattgtctctaggtacttgttatgttctaaacattgtgatagaccttgggtccttttagggaaatactgcaatttttggatcggtggatcagttaatgcttgacaaggccaagaatctcattcccctttgctgtccctacaggaaccctgtccagcatccccacagccctgacccgctggacagaagaatgcaaagttctcgatgctgagagcatgcatgactgtgtttcaggtgcgtggcagcttggttatcagggcaatagtgagccttccagagctagggcaaacgtgtggagagttgtttccctggttctctgtggctacaagctctgcctcttggcttcctccctgaccccaccagagcagcctttgatttttgcctctttgaaacagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacaggtgattcccaagggctgggaggattcatctttgactgtgtctgccgtaatgtggttttggcatacacatggcaccaggaatcactgaagaatcctagaacgttcacgttgaacctgggaaattttttatttcaaattcaccatacattgacctggtttttaggggaaagaattcaaacctagaggggagatttctcaagtgtcaagggaaaaactggagccagaagcagaatggcttctcactcaacagtcacactgcatagtctctaccgccaaggacagcatcaagacaaggagaaaaaccttatctaagtccatgctcttagtcgcccacttccatttctgtcggtgaactgccagtgtggggaatcttaccgagatgaccccattccgtcatttgagtaagatcagcctaggtgtcagatcagagaaaatgtttgtactctgaaccccatcaccacatgtcattttttctagggctcacatgtataaaatcactaatacaattttggtttagaaggaagttacctacttttttctgaaacttctgggacctcagacagagatcttttaaatgtctgagtaaatgttgatagaattatacattacagtgtatcacttgatataaaagggggaaaaactgatagaaatacaaagaaataagacttgagagtgaaagactttagtataccctactcagcagttaaggaatcaggtagattaaaaataagggtagtgaagtgttcagttaaaataacaaggttgatctaacaaatatctttatatagaactttttacctaatacacacattgtttcaaacttgatataggatgaaaaataagtgaacctagcctgtgactgaaaagactagagtggacaaaataaaaaataagccccatgaagggaaaaaatacatagatgaaaccaagaaattcttgctagaatgatcatgatcgtgcccatccctaaggggtttttattatcctttccttccatatttatttccccctcagccccaaacaattcttgaacctgagtatgtatagagaaattggtcatatatttgcacagtgaaatgatcaccttcctttggtcacatggccaaagcattctccattagatcactgaactcctagatggtctgggtggaggatggtgactattacagttgacctctatcttaggtgcttgcaaagtcccacattggtctatcccttctttttgcagtgtactgcatctaagtcaaatgactccactgaacagaatctctcaggtaactctccttccctttctcccttcttactaatcaattggttgcttctttatcctgatagttccgagtagctggcccacataggctgaagatggacactggtgctctgtgggatgaggtagtagattgtatagttttagggtcataccccatcttggagataactatacagtctactgtctttcccacggtggtacacttcttctccgactggctctgttcaggttcttgttctggttattatctactttgttctggcatgggtaatgaggtcatgtgtcttgttcatttcctgactgcaactctgtcctctgaaacagcatgttcatgtacatctttgaagtggctggtcctttgatgaccaccatggtgtggcacttcatgagaataactgatgacagtggttctcaaatgccagtcctctgtggaaacgaacaaaatcaaggagctttaatgcctttttcataaagctgaatttattccatttaaaaggctgtttttgtatttagagatcatattcctaattctgtggtaccaaaatatttttattaaatgatgttgattggatgttttttcttacatggctaaactaaaagttggcaacccctacattagtctctactttttgttctttttttaattaaattttattggtccatggaatctaaaagtctaggaacattgtcttggatagtgtgctgttcatgaaggtagctctctgggcttagtggtatgactgccgtatgtttcctattccctctgatcttcttaacaatggtcagtagccattttgtgattctatcagttggttcatgtgatatcatatgtctcccccacccatatttcctcagaacattcttctgcctccctacacctgtctcctttcgcacttgagttggaaaatgattgtaccaaagcctgcacaatattttttaaagcagtgaagtagggtagatgccttggtacccttaatctagcaaaagatctttaaaagagtctgtcaccatgtaaaatggccttttgcctgctgcccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcagtggttcatgcctgtaatcccagcatttttgggaggccgaggcgggtggatcacctgaggtcaggagttcgagaccaacctggccaacacggcgaaaccccgcctctactcaaaatacaaaaattagccaggcttggtgacactcgcctgtggtcccagctactcaggaggctgaggcaggagaattgcttgaacccaggaagtggaggcttcagtgagctgagaacacgccactgcactccagcctgggcaacagagcaagactctgtctcaggaaaaaaaaaaaaaaaaaaaagattttgaagggctggacgcagtggctcacgcctgtaatcccagcactttgggaggccgaggtgggtggattgctagagcttaggagtttgagaccagcctgggcaacatggcaagaccctgtctctactaaatatacaaaaaattagtcaggtatggtggcacatgcctatagtctcagctacttgggaggctgaggtgggaagatcacctgagcccgggaggtgaaggctgcagtgagccatgattgtgccactacactccagcctgggcaacagtgagaccctgtctccaaaaaaaacaaatagagttttgaacgaaattctgaccatttcttgctccaaatagatgaagtgggaggatcaataggattttggtagttagattttctgtgtacctataggtcagagacatttagcctcaccctatatggcctgaaatcttcccccttccacctgcagggcacagaaaggattttattcttagaatccacagagtcagagctccagttcttgcattcttgggacagagatagcactgtgccttaaccttcatccttagtataccagaccagagatgttccttggagtatttttgttgtggggatgatcactggctgggtgggatacttatcaggccacatttgctgattggggtggctcccctcatcattggctggttgccccttaaccactattattgttctttccgagaaagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataagtgagtagaatttcaacatttggggaggatgaaacaagagggaagaaaggatgtctttgtagcttctctttgctcttttgcttgagagaaatagtaggagttcaacttctcaaataataagatctcgtcttgcgcattcactttcttaagtgaagttgaggtcctgaactggtgatagttgaatgtctaatgatattggtgatgataccaacagttcattgaggcaattactctgtttctgggctatcaccccaggcttattatttaaaaacaactctccagctgggtatgatgactcataatcccagcactttgggaggctgaggcagggggatcatttgagctcaggagtttgagaccagcctgggcaacatagaccccatctctattggggggaaaaaaaaactctccaaaatcgatggtgttatttacatgagtaaactgaaactcagaaatgaaataattagcccaagtcactctgtaagtggttgaactagaattaaaacccagatctgtctgactttaaagattactctctccttccacagttcccaggatggcaagcatgtcatcccacacttagagctctcccattctcctggcagacactgtttatctcatgacactatttctcactggtttgaaatggggcctgaaaagtcttctcagcagtatttcaacaggataaattgatacctgcttgccatccctgctctataccatcttgcttgtgaagttctctggagagaccctaaggtgtcagttttttctttcaaggaaccttgtttattttattttattttattttatttatttattttttgagaaaaagtctcgctctgtcacccaggctgcagtgcagtggtgtggtcttggctcactgcaacctccgccacccaggttggagtgattgtcctgcctcagcctcccaagtaactgggactacaggtgcacgccaccatgcccagctgatttttgtatttttagtaaagatgaggttttgccatgttggccaggcttatctggaactcctgacctcaggtgatccacccgcctcggcctcccaaagtgcttggattacaggcatgagccactgcgccctaccgaaaccttgtttatttagagaactacagggatatgcacgtgcaagtggtgcctgcagtgaatcaaagtgaaaaaatcccttacccgggctgggcgcggtggctcacacctgtaatccaagcactttgggaggccgaggcaggtggatcatgaggtcaggaattcaagatcagcctggccaagatggtgaaaccccatctctactaaaaatacaaaaaactggccgggcgtggtagcaggtgcctgtaatcccagctcctcaggaggctgaggcagagaattgcttgaacccaggaggcggagattgcagtgagccgagattgtgccactgtactccagcctgggcaacagagtgagactccatccccctgccaaaaaaaaatcccttacctggtttgcctagggaagatgtttcacaggcatgcctggaacacagtaaatgttcaagaattgatagaaagggcttcagctgaaccttagaaatctcaaagtgagattgagagggggacagcaagggagaagtgagaagtctgagctgagatgcccctaaggaagcagccctatcaaagaccttatctgtcattttgccccggttccagatagaaacctaacctctccctgcaacttcttcctagcctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacaggtaagcatgtgtgggcaaaagaagggtaggatatattggagggtctttcaaagcacatttcatactcgtcaactaatggacatgcttgttatgctggggagataaagctggtttctgtgagaaaggggtattgtagcagtgttttataaacgagaagacataatacagacagcaacctgagcatgatttccctcagctccccacctgcatcctctgagagctcttccaccagagattctgccgtggccatttctggagcagattcccgaggaatcctagaagagccgttgccttcaacaagcagtgaagaagaagatccccttgcgggtgagttccgtgtatgcccaggtcatcctgggattgttttggcttctagtagcccttggcatggaaatgcccaccagccaaacagttccatttagatggagggcatgtatgtgggaggactgacaataagcgggggtgctggtatggcataatgaaacgggtccagccttaggagtcaaactgatcttggctcactcaaattcccccactctgccacttctaccttttacaacctagggtcattatttaatttctgtgatcatgaatgataccgagggggtgatgatatctgcgtggtaggttatttatgaagggtaagtaacagtgcatgcagtctagcaaataacaaaagctgttctgagcccagggaaggtggggtgggccttctctgtgtcccatgtcttgcaagcagtgaagacatatacactggtttccctcaaggagtgacatgggtttattttctccaagtacatattaggcaccaatagaggtgtgagaggctgggcgcggtggctcgtgcctgtaatcctgaaaatttgggaagcagaggtcagaggatcacctgaagccaagagtttaagaccagcctgggcaacatagggagaccccatctctacaaaaatatatatgtaaattagccaggcattttggtgcatgcctgtaatcccagctactcaagatgctgaggcaggaagactcgagcccaggagctcaacactgcagtgaggcaagggttgcaccactacactccagcctgggcaacagaccaagaccccgtctcaagcaattaataaggcgtgaatccctttacatgttatatctcccttcaggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtatgtgagcgggaaggtggtggggccaggctgcctggcaggagaaatgccctcattgactttttctgctccataggtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccgggtacagagggaggcaagtgggagggctctggaaagctttagccagatgaggctatgttttcttacctttgtattacctatatccagtttacaccctctccacaatctcagttttctttttctttccttccagctttcaccagtcgcttaagtggcaaccgtggggtccagtatactcgccttgctgtgcagagaggtggcaccttccagatggggggtagcagcagccataacaggtacctttgtctatttttaccttaccatatcaccactcaagtctattagcccagctcccttagttttataggtggagaagctgaaatcctgacaggcaggatggatggtctctctaagccatttccttgaataagtgagagagccagatctttggactccccattcagaaaactacaccttttggttagtcttgctaccaaagaccacaatcgcaaaagcaggccggcagcaggtgctaactatggttttaacaagaaggaacaccacttgtctcccatgcaagtagtaaaacaactaaccacctgccttgagtttgtaacacctaggctaaggaagtatagaggagtgagttagccaggctaaaacagagtgggcctgacatgccaaaatgtgaaaggagtgattggttcctacaaggccacaaactcctggtagtctagagaaggcagaaactagcattgtctcctagacttaggtatggtcagattttaccagtcgatggatgatacctgggctggaatctctgctgtcttctcagtcgccgtgtgatgtagggcaagtcacttaacctgtttgagcctcttgtttatcatctcaaaaatgggtggttctcggccagttgtcgtggctcacacctataatcccagcactttgggaggctgaggcaggtggatcacttgagtccaggagttcaagaccagcctaggcaacatggcaaacccaatctctactaaaaatacaaaaagtagtcgggtgtggtggcgcgcactagtaatcccagctactcgggaggctgaggcacgagaatcacttgaatcctagggggtggaggttgcagtgagccggtatcacgccactgcactccagcctgggtgacagagcgagactccatctcaacaaaaagctggtgggggtggggggcttcattctctaagctgtacagcagccctgaaaggatgatgtacagtcattgtaaagtgcctggtacatagtagacacctaagagggcagctgttactatgaagagcccttggactggacacccacctttctcaagcctccttggagatacctagctcattcccctcccccattcttatgcctaatcccagagctctagccactgaagtgttacccaaaaaccatgttctgtttccaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtgagggtttcaaacccaactcctggggatggaagaagggtggcagcaagagcctgggtgaaagttgaacactaagcaggctagcgtgtctttttgctcttattttaagtgttgagccctgtattgtttctaggggattgtcctatatatttctggggttttttcttcattcttttccatttttatgtatgtcttatttagtcatcaaaacaactgggctgtatgattcctgttttacagatgaagaacctgagattcagaacattttattcattttgtcttatgattagaaagtgatggagctggacctagaatttagtgttctttcaataataagcattgctgccatctatcaaaggcctgccttgtgccaggcactgtgcaaaatacatcatgtcgtttaatctccaacaactttgcaaggaagtgtagttatctccattttataagtgcgagactaaagctcaggaaaagtttgctcgtgagtctgtattgctacaaagccctcattcatttctctaggctgctttactgtctgttggataaaactcttatatgacatatcccccaatatttaccaaaattgtctgaaggagtctgggaaccagttgtcttttccctatcaggaaggctcatcctctgtgaagacgtcctagaccaagccttgtcctccttttcccggcaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaagtaagtgtggatgtagactgggagctgtggggtatatactgtggcacccacttcacccccttttccatccagatagttctccctcagtgatagcaatcagcttggtttgtgtttgtgagaacagaatgtgttcattctcaccctcatctgtcccagttctctcactctgtctcccttcctccatccccgtctctctgtgtctctctctttctctctctcccctgcctctcacacacacactcttttgaaggtcagcaggcattcactgaatgtagcttccctaggctaggcaccagaaggaggaaagaaagttaagttccatcctcagggaattcccagcctttccagttgtgttgagggagccagttctcatgggaaatagttcaagggcgggcaggatacagtgtgattcagagtaaccagatcatcccaggaaataaaggtaatgagccctgccacagattagtaagaaagaattatctgaagaagtaggttttaaagaatagagtgggccatgatggtgggggaatagttggaagaaatgcctggggtttctttttcagcttagaagttacagtcataagagtcctctttgagtttatggtgagacgtgattgtgccactgcattctagcttgggcaacagagcgagaccgtgtctgtaataaaaaataaaaagcctttatcatcccaagtcatttagatttgcctttggtgggtgggttttctttttcagtactttcccattttgaagccctgggcaattcagcgattccttgattttgtcacttagtccctggcttgtgagtttcagagaggcttacagtgttctgtctgtttcctcaaagtttctcccactactaagggcagcaaatctccagcgaaggtgagtgatgggggcagcagcagtacagactttaagatggtgtcctctggcctcactgaaaaccagctacagctctctgtagaggtgagtccaagctcttctgatctgctaagacttggggagaaaggataaacagggtagataatgattttgttctcaggctggggcttactccttctgtcttctttttctcaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaatagcagaagtaaagcattttctctttctgaaggtttccacttaggtgcttcctctttctggaatcctttcctgaatccccaagctgaatcagatacctccatatccctataacacagcctccatgctccctctgtcgtaacacagattaccctgggttatcatctgttttcctctgctcagttgtttgaaagcaaggctgggtttgtctcctcatccccgctgcccggcacacagtggtgcttaatgaagagaaaagagaacacatgggaacagcagcgcctcctttcttctccatgctgggcactcgtaagagccccataagacagctgaggcagcttcaccccttcaaagtatgtccctacactgcattcagcctcaggaattacagagtcagaatagtactctctgcttttgtgtaattttgagggtataaaaattctaagaacagttacaaattacctcgtttctatcatcttcctccctgttttactgagaagaaagccaaaacccagggtgataaagtgattggaccaaggagtacagccaggttttctttcaacatagagtctgtctaccctgtcccaccctcatcccaatcatgagtctccctagatcttggctacatacttagttctctctctccttcacccccatgtccctaagtctggggtgataggagagttggttggcctgtataactcagggtgttctttgctgcatgaaaattacaacgttcttccagaaagaatttggcctctgacctttctctcttggctgccaccatctattccacacctatgggccaggcactgtctaggcactctaccatataattatctcttaattgtcacagcaacgttatgaggttaggcagtaatattcccatcccagtattaatattggttagcaaattgggtaaggggtcaagaaatttgcctgaaaccaccacagaacctcagtaattttgagagatatatgggatttcaaccatggtctgtttagctccagaggagatactgtttctcttctacatgaaactcatttcatgcagattcagcagatccctgtggccataggtaaattggtagtcccaggtgacggttcgtggacacgcataataagctgaacagagcacgattccagctcactctaggttctctgcagctgagcaatgaagagtggcctaagcaggtgtcttagagagatttggcttttagccactttaccaggggagtctctgaacacttgctgactcctctgcctgctcaggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtgggtggtagccaccctttggctgggggcttgaatctgggatattctggaagatggctcttgctggtttcctggtcttttttatttctctgggtgattttcgtatctttcctatacacacttgacccatttttttctacttcctacttggaagatttccttctgagtttccttacccctctggttgacaccaggaagccttgcttgctttgggtgtttatactttgatgctgtcaatatacgcaagccacctctacactatccaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggtatggaactagagtgtccagttgaggggaagggttggtggcggtaaagccagattccttggaggtgcaggacttaacggcctgtctccttcctgtttgacctttccaaaaggaaaatgattatccttttttcagaatgttgatggctgcattctacatctcattcaagctatctgcgtaggaaattcattagggggagtgggaattaagggggagtggaaatctggcagggaagttgggggccagccttttgctgaacaagacttaactcactaggtgcatctcctttctgcttccttggtcatttctaactaagccgtggcttgacaaatcattttccctacctctttcctcctgtcccacagaaccctctcgcacaaaaccatccgtctgtctagcatcatgccccctgcccttatctgtaatggtaaatcttagcgcctgatgatgagcactctgaagcttcctgagctaaagctcaaaagacctcagcaagatgccctgtggcagcccaggagataggagagagaatattgggctttccctcttcctatattttatatcttgccttcctctttctctttctcccaggttcctccggtttaggctcagctagcagcatccaggcagctgttcggcagctggaggctgaggctgatgccattatacaaatggtacgtgagggtcaaagggcgcggagacagcaacaagcagcaacggttagcatgatgcctgtggcccctcattcatttgtctctccactcatccccccaccatgtcatcagtggggtttcattgcctttaccttgtatgcttttgcattaagtttgctatatgaatgcttctggacaaaagggttactttctgttggtgttttcctatttgttgattggtttgttggtttgatttgatttaaagcttggccatcataccccactcccagctatccagtcaacagtggcgcttttgcaaactgcctgatgctaagtgttgtctgggttctgaggggttatggggtgaagttttttttcagtcccatggaacaatgcaggtacatcagaaacatctcaggaatcctaccattgaaagtcccccaagcttggtacatatcccacacagccacttctgtctgtggctgctccctccaccctgccctctgcctttattctccataatcccttggcacctaggcactcaggcacttttaggaggaaaccttcaggtacttaagtagccagctcagtgttggggtcccggcattgagtggctgcagtaaaagcctggcatcacatgtgtatgctgtggcactccctcattgttttcctgtccttgcaacatgtaagttacctttccaagatccaagaaaggtatcctaagacccgatatttctttgcgtataattactattatacagtatggttttattgagtaggcagggaaaagccttgaacttaggggcagtgactccaggaaggtagaaagggaaaataaagctgttattctggagtattttttctgccgagtctctttcccattacacgaaaagatgtcggctttttaaataatcccgctcatgagaggttgctctaattctcctattatttccccttttgtgagcaaacagaaacaaagagcagacctaccttccacccatctgaattttttatacacacacacacacacacacacacacacacacacacacacacacacaacagaagaagacttgaagtctatatacaggaggctagttctgactggtcacaggtctggattgtagactgtaggaaatgtaagcatccaaggagctgttgggaaaagcttacaaaacacagtggagaaaagcagaagagttgggaaaggcatccttttgtcctggatagctacagttttccccacccaaatatgggaagcttctttgcaagctcaatgtatgagaagtggaagggccaacctctagcctgtctctaaggaaagcagagttgcacccttatgtgatttttgtctcccttttatccagtcggagtctagccagtcagaggcgtctgtccggagggaggaatcacccatggatgtggaccagccatctcccagtgctcaagatactcaatccattggtcagtactacttcctgtttccagccgagcaaaagggatagccagtcttctggaatgtctgctgaatcccctgctcccagcatatataagcccagtgttttcccatttgttccagtaaaccctggtttctgtaaatgatgacaggtgtttgacaaccaaggcacacttttctttcctgtagtaaaggaaagaaaatggtgggatatcatgcattcagacagcatgtttttatggggttttctcttgttgtggtggttgtttttgagacagtctccctctgtcgccaggctggaatgcagtggcacgatgtctgctcactgcaacctctgcctcctgggttcaagcaattctcctgtctcagcctcccaagtagctgggattacaggcgcccaccaccacacctggctagtttttgtattttttttagtagagacgagtttcgccatgttggccaggctggtctcaaactcctgacctcaggtgatccacctgtcttggcctcccagagtgttagaattacaggcatgagccactgcgcccagcccagcatgtgttttaaatcttttgttttattattgaggcagggtctttctccatcacctaagctaagatacagtaacatagtcatagctcactgcaacctcaaacttctgagctcaatcgatcctcctgccttggctatctgagtagctggaactgtaagggacaggccaccatgcccagctaattttttttatctttgtagaaatggagtctcactatgttgcccaggctggtcttgaactcctggcctcaagccatcctctcacttcagtctcccatgtcttctttctttcttttttgttttttgacacagagtctagctctgtctcccagggtggagtgcagtggtgcaatctcggctcactgcaacctccgcctcctggattcaagtgattctcctgcctcagcctcccaagtagctgggattacaggcgcctgccaccatgcctggctaatttttttttttgtatttttagtagagacagggtttcgccacattggccaggctgatttcaaactcctgacctcaagtgatccacctgcctcggcctcccaaagtgctgggattacaggcatgagccacggccgaccagccttagtctcccgtgttttaaatcttggctcccccatttactgcttctgggacctgaggcaaacctctttgttaggtttccttgtttaaaataggaatgttcagttgttaggattaaatgagttaaaacatgtatagtggttagagaagcacacgatgaatgctattgttagcagcatttctcaaagtcagtcatacatagaatacattttggcaccctcataacacattcccatggaatagtattcttgtaggacaaccattgttatcctacctttcatcaggatttggggagatagatattattttcgtgttctgtattcaccttcttttacctaaggtcatatgatttgcaagtaccggagccaggattcaaacctaaggctgtcagaaccttgaagaatagtcaggatttgggtaaaggatgaacagcaaaggtcaggaagaaacctaagcagggccaggtgtatggggatcaggggttgatgagaaaacagtcacttactccccacccagaagatggggttgtgtcttgctgcttagctactgagcagaggttagaataagcccccagtgagtatcaggaaaagtaccagccatgggattccatctgtcataccatggcttctcagggttttaaactgccccaggacaagatgactaatttagaaggcattagaaggccgggcgtggtggctcacgcctctaatcccagcactttgggaggccaaggcaggtggatcacgaggtcaggagttcaagaccagcctgaccaacatggtgaaaccaagtctctactaaaaatacaaaaatcagccgggcatggtggcttgtgcctgtaattccagctactcaggaggctgaggctggagaatcgcttgaacccaggaggcggaggttgcagtgagccaaggtcgcaccactgcactgcagcctgggcgacagaacgagactgtctcagggaaaaaaaaaaaaaggcattagacttaaggttagaaagatttagtttgatgtcctggtgctgtcttcctcagaaaccaaaatgaggaaaagacagcctactttccaaggccagctgtcagaattcaatgacaaaagtgtcctaaaacatcctgtgtaaactggaaggcaaccatccaaagctccactgttgttacattaccctgaaataatccacagattctcttgaaactagtgaggcagtgactagactagcactatctggatctgcagtagcacctgtggcttttgagcaccttaaatgtggctagcgcaactgaggaaccagattcattattttatttattctgtttaatgtaaatgccatccaatgcaggtcctagaccttgtttcagatgttgctcggtgagtaccactcagtggccagtggtcccctctacttgttctgtatattagttggtgcgtgtggtctagaaagatctaagcagaagggaaattttgaagactttctgactctcttctgtgtgccctccagcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctaggtgagttgtgtcctaaaggcccaggtcccaacccagtggtctgctctggggcccttcctgccagcttgtttttcttccttccaggttactcctctccctcagtgtctctgtaatgagaattcaaaagagaagtgttttttctctgacttcagtataaaaaagattgaccttctcttttaatagttggtgtctttcactttatagacaaggggaatctttataactggttagctatcccatttttctttggcttcaaggaagttcctctgtgacttgattctaccatatttccctgcaagttctcattgtttcttttttttttttttttttttttttaaatcagaaatgaggtctcactatgttgcccagactgatctcaaactgctgggctcaagcaattttcccacctcggcctcccaaagtgctgggatcataggtgtgagccaccacacctagcctagttttcactatttcttcttccttatttatttttataatttgtttatgatggcaaagaggtttgcatgttgaagtttgcagagtaaaatgttacttctccatcattcctaaccctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcaggtacagggaacttttaggctgccaggtgtagaaggcttcattttaaacaggattgtttcatacagttaatccttagttgatgagagagagagagagagagagagagagagtgtgtgtgtgtgtgtgtgtgtgtgtgtacatacacacacccgtgcacgtaaaccctgcatggtttcccttggcctcaggatactcaggtttagaatagaaatgctcagattcacgttcacacctcaagggctggcccttggttttgactagtccttttagagccctgaaataaggaagaggaaggaagagagagttgctagctggttggctgtcttacagcttctggggcagatgatgtgcttaattcctgctgtcacttctcccctcagagactcaccgcactgtgttaaaccagatcctacggcagtccacgacccaccttgctgatgggccttttgctgtcctggtagactacattcgtgtcctcgactttgatgtcaagcgcaagtatgtgtcctggatattggggggtagaggggtggtgagaactccccaaatggtaactcgcctctgaagttactcttgaggccacaaatttcctttggtgacagcacttggaatggtggtggtgaggagggaagagacagctgtagcattgatggccatcatacctaaatactcctgggcttctccaccccatctgcatttttcatcagcaaaacagagtcacatgatttttgaaccacacagtttctaaagttctgttccatccgttgggggtagtacaggaggcacaggtggccatagaacacacacagcagggttccaggggcttccacaacactcctggagtcatccctatgcctctccttctcctcgtgcatgtatacatgcttacctgcttgtggcagaaatcacatgtcacaatctttgtgggcccttactcagtggaggtaagaaaaatttagagttggtaatgagtgatctacctctcccaactactgggcatttcccaaacaggtgtggagcagagatcaaagtgtttggaggatagaaggagcatcattgtgggtcttcttcctaatcacacaaacaaatttgttctgccacccttaatcctatcttccttccttttctacctcccaagatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtaagggcccaggaacggagaaaagatggcgggtgggaggtggggcctcctgcacagtagcgatggcttgctctagcctcaaatttagggaggtgctgccctccctaataggaattccccataggaatctggttttagataatcttactgagttgtctcctatcttctgggcctgccctgctggctggccctttagctaagctacccaacaattcccagacagacaggaaagtctttggtgtttataaggatatacctgctggctttgcaatgagagctttaatattgctatactaggaatgaccatgtatgagtggcctccaccaaactggtaactgctcactggtgattctgaagccacctagaggagatcagcagtttgtaatactgagcgtaggagctgatgagatgaaagacctattggagttgtttaatgattcctccccatctcttgtggtgtgggctctccaactgtgtaatcacaagaagtcagggagtctccctagacagactgtatgccatgttcttccaccaccaaatacctttagagaatttggactctgggcttatccctctctaataccacttttctcccctccccacttcacctaagcaaggcctcatttatttctctgatacctttcctattggtgttttctggaatatctgttaaccttgactattttgggacatctcctctgtcagtggtgcttttgtttgctcccagatctccaccccatttctgggctgtcctggcactctctgtttacctcttcatctgacactgcactccccagacactgcttcacagtctctcactcacacaaatgactggatgtatcctgggttttctgcacagctcttttctgcttctgctttcttatgcaggtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcaggtgaggatgaggcatagtcctgggactgtcttcagtcctgggggtctggtctttttgtgtcccatccttgtgctccttcttcccccccactcgcaaaccatgaccctgtataattgtgtttttctagatatacagatatggagagtgaagattaccacttctaccaaggtctggtttatctgctggaaaatgatgtctccacactaggctatgacctcaccttcagcactgaggtaggtcaggaaatcctaatcacagcacatcccagccaatctggaagatccattccaggttcaccttagaactagcactgcgtgaccttctcatagttctaaggaagcatcttgacttcttaaagctgtagcaggtgtttgtgagtgacatcacaaacaggaaaaccagaatttgcaggccatttcctagtttcacctttattaaaaaaaaaaaaaaaaaaaaactccagtacataattcctcattcccaagggtaggtctttgtagaaaaatcgtacaaatgtaagtggggggaaaatgaaggcagttaaggttactcttctcctaaattcttttcctaagagattacattccgttacatatgttagccattcccttttcccttttaccactgatagttgccttactctcttctgccttttttgtaggtcttagagccaaagagtattttcctctttcctacccaaagcctttccctataaggggagttgcgagctatgagtagtagaaaaagtcactgttttgtatggacttgcctcatctctctgcctaggacatggcaaggggtttagggtgtgttcctaggtatctaatcccatcctagatgaagtctgatatgtatgattggtgttttggttgttctaggtccaagagtttggagtttgtgaagttcgtgacctcaaacccaatggggccaacatcttggtaacagaggagaataagaaggagtatgtacacctggtatgccagatgagaatgacaggtaggggaaatgttcctagacctctagttgctcaatatgagaagaggtcggacttgattcatttgataggcatgttttgttttcctctgctatgacagagccacaaatgccttgcacaaaagacaaaacacttgatcaaaaatacttaactttgggcacggtggctcacacctataatcccagcactttgggaggccaaggtgggcggatcagttgaggtgaggagtttgagaccagcctggccaacatggtgaaaccccgtctctactaaaataaaaaattagccaagtgtggcagcgtgcgcctgtagtcccagctactcgggagactgagacagaagaattgcttgaacccgggaggtggagtttgcagtgagctgagatcgcaccactcttctccagcctgggcaacagagtgagactccatctcaaaaaaaaaaaacaaacccagcttaacttcactggacacagtggctcacatttgtaatcctagcactttgggaggctgaggcaggaggatagcttgagcccagggggttgagactagcctgggcagaattaaccagttgtggtggtgcatgcctgtagtcccagctaacagtggtagatgggagccagatgggggatctctgacctctacggttgtgtgagtttagaagtcatttggctttttggttatctcaccaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcaggtgagctgctgctggcatccctcctcatatggtcctcttaccctaggcaacgctagtttgtgtgataccaaataaaccagtagtactcttagaggaagttgcatgtagaagacagtctacctatatctaactctttgttctcctgaagcatagcagacttctcttggccgtcttatgaatgaaaggagctaaagctcatcccacagaagggacttgcctcagataccaagtccagtcctgtttcctagattccatcccccccaccctgcttctaggagctttctacctaacactggcttcatgggtcccttcctacagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatggtaaaaggaagggtttgtttctccttttcagtgcttaggttgagcttgcatacttgatgttttcaggaccctacccaagattgggaacacaaatgtggctgagtcctggaccttgggtaactcacaatttggtgtttctatggaggtgatgtttgagatgagatgtgctagacacagtgggggctggggagacactgtcaggtaaacagcaccacaagagagcatggtgtattccagggccagcgtgactggagcaaggaggagttgcagggagcaaaagtctaaagagctcagcagaggtccgattaccagtgactctgaaaaccaccttcaagtttgcactttagcctatgggcgagtgaggccagggtgtttaaggaggagtgacagggtcagatttttggttttggtgcctgatggccagtttgggagccagataaagggggacatactgggctgagacaagattgggagtcatcaagaagcagggagttggtttcttcagggaggggaggggctggtgggcaccatgggaacacacagatttggttatctgtcatccctcaccacaaactgatctttcttctttccttagttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagcctt

SEQ ID NO: 5685 - DNA, 154568 bp, human; identical to SEQ ID NO: 5684

SEQ ID NO: 5686 - DNA, 102502 bp, human
gaggctttcgactgagggctagcgaggggagcacggctggagcagggctggagcagggctggagcagggctggagcagggctgaagcagggccgcggaccccgcacgctcctgcgggccccgcggagccattgcggccgaggtgagcgtctatccctgggctggagggcgagctctgtacgcgcggccgttctcggtttctcgcgggtggcagtggcgaggttggggggggagttcccacgggaccctgcgcggaggcgcggaggtggcggccttggggagcctgcgggaaaggctgctggaggggcatggcggcctgccccaaccctccctgaaccccgcctcctctcccctcccccaggcctcggcaggcgccagcggagagctagccgcatcttcgggggcagcccggcagctgccggcggcgcggcgagagagcggctgacagaggggatgcgaggtaccggcattagccatggccaagtggccctaaagagagagtagaggccgggccttcagcgtttctcactggttcgaggaaggcggcctcagaggagagggaaggtgaggggcgggcaggcaggcttcgcgggtaactactaggcgttgcatatatatgttttgatatctaaatggtactacacacacacacacattcatttcgactaactgcttgtttaaaaatctgagaatatgtcttgtagatcttcttatatccgggaatccaaatttatgttgggttttaaacagctgcattgtatgattgtactacagtttatttaaccatttcccgattgatatacattagcttgtttctctgttgggggagggaggggactattacaagcaatgccataatgaatgggtttgtgtatatgtatcatgccatgtatgagtatttctgtaggagaaattcttagaagagtaaccgctgggtcagggtgtatatgcattttgaattttgatagatttgtccaaattgccttcccaaaagcctgtactaatttacactctttaatgttgtgcgagagtgcctatttttccacagttatgccaacacgtattatcaatctttgtaattttagccaatttaaagggcaaaaaaatcgtatgtcattgttttcatttgcatttccctgattactggcgaaattgatcatatttttgtttgtaaataggcaaatatcaatagtttatataggcagttttcctatctataagcaataagcattttgaaattttaataataaaaaacctgttcgcaatagcaagagaaacgaataaaaatacctagaagtaaactataaaactttattgacgaataccataaaagaacatctgcatgaaaagagaaggaatactatgcttctgaataagaaggctcaatattttagtgatgtccatttttcctatattggtttatacagttgatgcaatttcaataaatataccaagtttttttggaacttactatgattctaaagttcatccgggggaaaaaaatggctaagaataactgaaaaaaaatattttaaaacgtaagtaaagatagggatatttgtactactggctattaaaatgtactctaaaggaactatttaaattagaacggacagaacaatgcattagaatggaaaagcccacaaatcaagccagattggatcccaagatttattggagaaacactgttggctagacgtggaaaaactgccatattaaaagcttcaggcatttccccccatccccgaagcttgaatattcctttgagggcagactcctttgtttggagaaaaccactttattggatctttttggttatgccaaggtaaagcttcagtagttaaaattggtggctttggaactagaactaatgatatggcctttagttagattaagatggattcaggttagcctgcagtgcggcgagggaaggagtctggataatgtaggtttaaaaatttttttccctatctaatgggcaaaaaatgttatgtcattgttttcatttgcatttgtgtgcttactgtgagattgaacgtcttttaaatgttagtccaggataatatgttattcctggagacaggtaacaatgggggactctttgctccgcttccagaatggagtttggctaattggtacagccttgcccggaagcgtgagaataaacaggttgactttttaaattttcctcaagcactaggctctagacacctagatcgggggcggaggcagttttcaggacatggccgagatttggcgctgagctgtgtcatcgcgaggtttggcagccagctccgcagtgggtcggaaacctcgtggtaggcgagatccctgcaggacgggagggttcctcccttcccccgaaaaactcccagtcattttcatgaagctccgcctttctcctttttaggagtgtgcaccaggtctcgcgatatctcatgtttcctaaaggcgaggcgcgggcggcatcctgcggtgaattaagaaggtctcgccgaggctaaagcgtaatatcgcgatagttctcaacgcatgcgggagccggccgtggtaggttggctccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtagctcgcgggtggggggtgggggggcagtgactagggtcggtccgcctgctgttaagatggcggcggaggctgatgtctgtccggccaggacccagcacagaggtgttggctatctgcctttatgacgcctctgaggtgcccagcgttaaggaggtgacgattggcgaaacgccggggtgccggtaaactagacctgaggcgaagaccacctcgtttcttgtccgttgaggcgacaccatttcctgggcctcggccgcgtgtgggcccgcctttgccccaccgatcggtcaacgcctccgttgtcgccgccgcagtgggcggattgggaagggtgggaggggagtctggagttcgctggggagtggggttgggggttaaattgaacggtgggaaagaggagcaaccaatgaagagtggcccctttcccctaccttttctgccggccaacctccgttctcagcacctccgacgacccggatgaataccctggtttttctcgaggtggggtcatcttcgccaactctcgcggttttagagctaaggcttagggttcaagcagtagtgtcactggtgtactcctcctcctctccccacacccctcctaattctgtcgtcccatctaatcttcatctacgtggatagttgaggctggtatttaagggaggggggagtcaaagcttttccctgtgactccttccccagttctaaattcgagtttagcctaagtcctctagcccgctctgtctcccccttccattggtccccttggcgcaggcgttgaatagagcttatcctgttgcctgcatttactccatctttgtggatggtgccatagtagccttccatttccttaagtcttcatgtttgtatgactctgatccggatttcttagctctgcatgctgctaaaccactattaagcgaaactatgaacgggtcggtgtttggatattgcagtttaagtggccttttcgtttacggccattagccttgccttcctcattcctccccctcagaaggctgtagaggataactctccagtaaacccgctttctgtcttccctgcctcttccatttcccctgcaagcctgggaaccgccccttttccctgccttgctctgagtttctggagcctcttggtctgtggacatctatttttgctgctgagcacctcttacctgcttctcacttcttaatctttctatcccccactccccatactccttttccaggagctgaatcccttagaaggaagataaccctcctctcaggctccactacattttaccccttccatttactagaaaacagcattgattgtcctgccccccagtctgccctgttctttatttcctcttccccccatgccaccgttactataggcagttaattccctatcatttgtttctcctttgtagattacatgttcagcattgttttcttttagccccagtgttgcatagattgaggagataccaacattccccagtcataggcggcggtctggtatggtgaaattaatagtgtgtgttttgggtgtgttttgggttcacattgaaccttgtgaccttgggcaaattttcagattctcagttcatctatataatgggaatagttgtgcttacattagaggattgttgctagaattagttaaaataaaataaaataaaatgtttagctcatggtaggcacataataaattaggattactttttggtgtaagaatgcattggtagatgtacctgtgtcatatgctaattttatgacctgggaaagagtaagagatttttgtttctttaactgtacattcttggtgtatttctaggccagatctataacgtttatattttttttcctcataggccaaactttttatctccagtggttcatgatgtttgaacgtgattcccactctttgtttccttctaatggtctaggaatttcagtgcgtaatcactatcctggaatgaccaccagccataatgttcctgtcaagaaccacacccaagtgttctaccttttggaaggggtgcctcatgccctgcctactcatttcttccactccttcaaaggcagtctgtcctgtcattcactctacaaaagtaatttggtgtcatgcatttcacagtggtaaaaggaacttctgttagctagttttgaagtattcatgctacttttcacctccctcatttgtttggttcctcagatcagtgtggggatctgctatttggcatcttcttacctgagcaagataattcctgtccgagagagaaagatcatttggaatacccagcttcttttccatagcaaattactgctggctctttaatacactacttcctgttgtgttattgccattttatattttctaacgtacttattaaacagatgtgactatttgacttggagaaagttttccttacttttttttttttttttttaagatggagtcttgctctcgccaggctggagtgcagtggcgcgatctcggctcactgcaacctccgcctcctgggttcaagcgatttacctgcctcagcctcccgagtagctgggactacaggcgcgcgccaccatgcccagctaatttttgtatttttagtaaagacggagtttcaccacgttggccaggatggtctcgatctcctgacctcgtgatccgcccgcctcggcctcccaaagtgctgagattacaggcttccttactgttaatatattgattagaccaatattaaagtgtagcattttacaattttttttttaactaattctagcaacaaccctttaatacaagcacaactatccccattattttacttcggctgggtgatgggaattgaagtagaaacgtggtgaaaagtttactaggatttaaaatttacaggaggtaaccatcccacaattagctgtatgtggactctagtttcgaacttcagggtctgctttatttaatttgaagtgctttgtaggtaataaaattttcttccattttcattggagggcaggaaatcactttctgttttgagattttgcattggtgcattttaccgtgggttaagcagtgatcacaaatttattaaacctcaatttcaatttgacccttattgagcaatagaataaatctgggaatgataatctaggtgtgacctaaaagtttaacttattctaggtagatctctgagaagagaggaaggagtgacaataccaaataaaaactttgtctaaggttcaatggcaaagttcaacctgagttgccaggatgtttatcgtttgtctcccaatatggccaaaaagcatgtatgaaggtgaagaataatttttatatgtacagttgttgttttttttcacagaaacaatgaaacaaatacgtccttagtgtttatattgagggtataaacttgtctaaaaaataaactgtcttctataatttcatttgggttgagaactcagttttcaggaatgttgtctaagcgttagaagtattagagttgttggttctgaattcctcagttacttctcaaagcaggtcctaaaaaatgcaaatagatatgtaaggactattgctttagaaataataactagttatgtttgaacataatagaatggttaaccctcctcacacaccctaataaatgtgttgtgtatctcactcctctcccccaactttttttttgtaggtcctccagcagcctgacctgagtgggttagtgatccagagaaaccagcaggccaacttggtcaggaaggttcgggaagctgttggagcagtgtggggaatttcccaccaggatgagtatgattggctgtgattttaggttagtttttgtaaatcttgtgggaagtatttgtattttacttcctggaatggagatagtaggggtggatgtattcccattctgtaatggagctactttggtttcttccattctctggatctgatgtggtactggttgcttctttttttaaagtggagctcattactgaattaaagggaattgtttaaatgaatgatgtctgtacatgattttttaaatcaccctaggcatcgttcaaaaaataaaattgcaagtcattatgtctaaccagttcttattaaagttacgaaaaatttcaaacatgcaaacattgaatagtataataatccccccacttacccatcaccagctttaatagtatcaacttgcacattctatttcatctatacttctgtttgtttggttttttttaatttttttaaattgagatggggtttcatcgtgttgcctagactggtcacaaactcctgggctcaagccatcctcccttcttggcctcccaaagtgttgggattacaggcgtgagccaccaggcccagcctgtttcatctatacttctaaccactgcccccctcaatggattatattggaataaatccctgtcatatttatttgtaaaatacttgtttgtatttctaaaaggcaagggctctttaaatataagatcaaaactattatcacaactgaaaaaattaacagatatttaaaaatatcaaatataaaatgttcagatttctgatttttttttaagctttgttttttttcttttacagtttgtttgaatcaggatcctgagaaagcacatttattgcaaagcattgatacagctgttaaatctattttaatctgcaggttctgtcttttgttttttttttcttccaatttatttgttgaagaaattgtcctatatatagtttcccgccccccatatttggggattacagcccagtagtggtgtctaacccattcttgctcaattaaagaccctggaggacccattataatggaacaatggctataatctcctgtatcctagttggagttgatagtgctgtcataggcactatcctaaaataactagtcatggattcctttttctgtggcaaagtctgatttgatacctgacttcagttccatgtcttggccttgctcattgctccacatgaaaagtaggcctcctggtggaagaagctagtgtttcctaatgacctgattgtgcctttggggtttttcatgcatggtttcaatttccttaggtgatttagttatttttatactactttataatgttgctttttattcttttgatgttagtgtctcagctgttctgacccataacttctaagctattaagacctaataatgagttcctggctgtcatacagttcttgaaatggcaatactaaaacagtttttgagagcttctacttacatgttgattttcagctattatacacaaccttagttttcctactgtgatttttcatttcatttcatctgaaatttatgtttccttagcataaagtcctttaaggacttttaggctgctttatgatgatctcactatctataaggttgatattcataagtacttgggcttttggtgttttgctgtattattcgttgtttcctcaacgactggttactagatgtttatatatgttaatgtcaggaataactcaacttttaagtcgtttgatgtttcataggtggtgttgttaaaacttgatgtacttgttgaccagcttggtcttctggatatagaaatcctttcaggtagtgaagaagtggctctatgagtaaaacaactgtaggttttgtttgggctgttaacctgagcattttcaacttttaagttctctttaaaagtttttagtcatttggctttaaaaattacagttggtggcatagaatgatcccataatgtgattttacagaaagttggaatgttttaatttattatgaatgtaccattacgtggagattgggattgtagatctgattcagtctggattgctgattgaactagatgaatgttaaaattcttcaactctgagattctgatggtataatcttaggtattgaaagacagcagtttttcctttcagtagtcattaagtaaatggtgactaaaagtagggagatgaattattctggaatgacctttcactataaccatttagatttaaaagattgatgagtctgaggatactgtcatgaatttatgtaccacctttagcacaatccaggttttaggtccttgtgattagatatcagagataattgccccagaagtgcgtgggtatattacatttggtggctgttaatgttttggaatgattttggaagattactttgggtacattatttgctatgattattttcttatattcctgtctattttatagtgaggcatgtttctcctggtctttgctttttttttttttttttttaaacttccaatattctttattacggcattctgacaattgagttcttacaggtggaaagacctttcagcacagcgattaagaacatggactctggagctagattcacagagttcaagttctgactcccatttcttaccaggtgtgtcatgttgtgcaaattacttaactgctttgtgccacacggtccttcatctgtaaaatgatgataatactgcctgccttatagagttctgaagaaatttagctgagttaatgcatataaagtgcttagaacaatggttctgaaactttagggaacatcagaatcacctagaggacttcctaaaagattggctggtccccactcccagagtttctgattctgtagatctaggaggggccccagattttgcatttctgataagttcccaggtgatacttctctatttcctgcaaattggcagctggatccagagacttgataaatttcaggttcgttccctttggcaaatatattgcgggggggtggggtgggggggtgttcattcacaacattgattatgttacgatgacttgaattttttggatccattaatttgttggggggctacaaaatggtgacgttctgatgctatcattttgttttcatctgttagctggaataattttgtttcccctcatcttttatttggttactcagcaatatagtttatataggaagagcaggataaatactcaattttttaaaacattgctttcaagatgatgaattggtcccctgtcatcttcaaaaggttacacatataagtgtatatataactatgcatccatagatgtaaacatttgatgggtttcaatacattgcagttctgatccttagcgaagttcaaattgcccttcttgtggctagtggaactctcttaaagttggctcctgattcttactgacatgctctctagtagtctttgatagcttccttgctatctggtatgtcaagatgtttccaggcgcattcttgtgcatttctgccccagacctggaattagctaatgggattaagataaaaggtgaagtcaaaagaaattctgtttttgccaagggtagcttggaactttctatcaagttccacttttctctttccacttaacctccctagcctgcctcttcattcttctctacctttttattagagttaaggtggaaaggtttgagaagccttgataatcataggaagatcatggagcccaggcagttccggatttggggcctggccacttactaggtctgtcagtttgggcaagttaacctatatcagttatgatgtggggaaataccttattcatatggttattggaattaaagagaaaatgtaaggtgttagtacatggtaggtgatcagtagatggtaatttatttaatgtactattttacttaactccttcaacagctcagaggtgggcagtcagggtggtgaaaataatggccatttaacaaaatgtgtctggaccctttaggtctgtgtgggatcatcagtggtgaggcaggatagggtttgttcttgagttattttgggtctgagactttggccagtgataactgaatgttccatagagtagtttttcactttggaactccttaggagtcacatttataccctctgaagggtcttagctagttctgtaatgtgtattacattggttaccttgatctctctccgtctatactggcccctcctattcaaggtgttcaaggttctgttgtaaccttagtaacctataataagtattcctaatagtcatcagtatcaccactgttaacacatttgggcagcaccatgcatggcaggtcagcaaacaggtaaatcttatttttttaaacattacacataatatctaaagtatagtatgtggcatgtaataagtgctgctgaataaatggaagtcattgttcagtttttagcttaatatatctttttttttcttttaacataacatttactgaatgttgctaagtataaggagtaagggacataaaatgaatgagacttggtctctgcccttgagaaactcacagtcgagttaaggactgtgaaatcatgtttaaagttccttagccttttcctttgtgtcatcatttcttcccctgcactgtctatgcatgatatagcctgtccattgtttctcacagctttcctaattctgtgtgcctccccagcctttgagactgctgatatgtgagaaagccaacaattgtcttctattaatacagggtaatatcaagaaaaacctttgggccaatattggatttcagagtggcatgtgcagttgacattacaataccagtttatggtctttagatgggcctgtacacctgggctccagcctctttcctgtgcctttaaactgccttacttccatctttcctcccctataccctacccttaatgtacttggtacataaaaatagaggctcccatacccaggtagtgatcaagtacaatgtaaagaaacagctgtacttcatataaactaggattcgagtgggcctagggtatatcactaaatttccattcttatctataaaacagtaatcggaaagcctatttcataggttgctgtgagcattaaagcgagatgatgtatttttaaatgcttgtaaagtacgaagataaggtcattataatttatataaaatacttagtagctatgttacttggggcaaattacctcatcactgagccagtttcctcatcctttaaatgaagatggtgatattcatttaacaaatatttattgaggacgtagtcattgcagctacatcctgggaatacaaagataagtgactggagaatgtaggacagtgtggtctaggggaaggagacttgcaaatcacacaaaagggtcagtatggtaatatgaggaatgaacaaaatgtgctatagcagtttacaagaaggcatcagagaatgtcacagagttttgttagggttaagcaagataaatgaaaagtacttcatgaattcaaaaatgctatacaaataagttagttaaacgtaccccaaatgaatcaatagtctcaaaccattattgtttcatttcttcacaagacttactctttagatgcatttatttctttgagctagattttatgacctccttaagggtaacctgtagtagagtatcctgaaagttaatgcttttgtctaaaaggatttttttcatccattttatcattttctagtttttaatcactgaattcaggaaaaactagaaaatgtgtgcatatttggggagaggatatacataattccaccacaatgtttagtcactgttaacattttggtgtattcacatcttaatgataagggtagtgtttaaggaataagaaaagaaatctagtaggaaattttaaggataggcatttcccagaataggaaactaaaaacgtccactaacaagaaatggtactcaaactaataatcagaaatgcaaatttaaataaggtcatttttagtcattagattgataaaaaataatttgataatatcaagtcatcgtaaaaggtataaggaagagtctggccttataatactgcctacaagtggcgtaaattgatacagctattttggaggcaattttggcaagttgcaagagagtacatactatgtgatgctatttatgttttaaaaaaaaccatggcaaactgacaactttatttgggaggagggatcatggggaactttacctttttctgtaatatgtgcatttctacttctgaaaaatatactgagaagtacagagaataatacaacaatccctgtccctacccccactccagaattgatcatttttaacatttatttttgccttacatttttttgtggagttggaagtaacacaagttgagtgtccctaatccaaaattcaaaatgccccaaaatgagtttcaacacgatgccacaagtggaaaattctacgcctaagtacttaacactttgtttcatgagcagaattattaaaaatattgtatagggtacaacgaacattatttgggtgatggttacactaaatgtctagacttcactactgcacaatatacccatgtaacagaactgtacttgtgccacctaaatttatacgagaaattgtgtaaaattaccttcaggctgtatgtataaggtgtgtatggaacatgaatggatttcatgtttaaacttgagccgcatcctcaagatgtctcatgatgtataggcagatattcaagaatctgaaatctgaaatcctgctggtcccaagcactggataggagatacttaacctgtataggtaaacaggagatacttttttaatacccagcattcccttccccccttacaatcagtacaatgaattgcttgaatttttctactgtgagaatggtataaattatgaatgtaagtaaaagttcaaaaccgatgtggtggccacacaaaaacctattattaaataatattaaatttgtacagtattttagagtttgtaagaagcattctgattttagtaagaatgctttgggaatagaactttttttcgtttgctcattttcttgttaactcttgtttgaaaacgttttcctgaatttgtttttaagtaatcttcatgactgtagaattatacatggcttattgttgaaaaatacagataaacagacaaatttccgcaaaccccaaactcacagataaaatactcttaacattttggtatgcagtatcttcttcgaaggcttttcttaactgctctgtagccatattatatattttttcagaaatgctctttttaaaatgtaattcattacctcccttccagctttcaattttgtatgaaaaatttcaaacaaaaatgctgaaaacatagcacaatgaacatctgtataccatcagctggatccaacaattaagtatttgccatattagatttatatgtacagatgtgtgtttaatttttctcaacattagaagtaaggatgacactttatccttaaatctttcagctgcatgtcttaagaatgaggacatctcagccgggcgcagtggctcacacctgtaatctgagcactttgggaggccaaggtgggtggatcatttgaggtcaggagttcgagaccagcctggccaacatggtgaaaccctgcctctactaaaaataaaaaaattagctgggtgtggtggcacctgtagtcccagctactcgggaggctgaggcaggagaatcacttgaacccaggaggcggaggttgcagtgagctgagatcacgccactgcattccagcctgggcgacagagtgagactctgtctcaaaaaaaaaaaaaaaagtaaggacatctacaaaaccacaataccattatcacgcctagggagtttattttttcttaatattatctaatatccggttcatattcacattttctcagttgtccccaaactgtctttttttccaagctgttttctccaaactagtgtagaaatggtatttttaactttgctcttcccacatattgacccctgtttcatgtctttgtcattatgtatacttctgtagcatttttaatggctacattgtattctattgtatgcagaatttatttaaccagtttgctttgttcacaccttttgctgtgttcatacttttccctcaggtgtccccaaactgtcttttttcaagctgttttctccaaactagtatagaaatggtattgttaaatttgctcttcccacgtattgacccgttccatgtctctgtcattatgtatacttctgtagctttttttttttttttttttttttttgagacggagtctcgctgtcgcccaggtcggagtgcagtggcgcgatctcggctcactgcaggctccgccccccggggttcacgccattctcctgcctcagccttttgagtagctgggactacaggtgcctgccacctcgcccggctaatttttttttgtatttttagtagagacggggtttcaccgtgttagccaggatggtctcgatctcctgacctcgtgatccgcccgcctcggcctcccaaagtactgggattacaggcgtgagccactgtgcccagcttctgtagcatttttaatggctacattgtattttattgtatgcagaatttatttaaccagtttgctgtgttcacacttttccagtcccagtttctcatgattttaagtaatgcctcctaacatacaggtaattcagcattcagtaaataagtgtcgaatgaaagaagcataggtacatcctaatagataaatatttatgagatccatatttaatatttttaattttttatttccataggtttttggggaacaggtgatatttggttacatgagtaagttccttagtggtgatttgtgagattttggtgcacccatcactggagcagtatacactgaacccaatttatagtcttttatccctcacccctttcccatcctttccccctgagtccccaaagtccattgcgtgacatccatatttatatccttaagaaatttctacaaccggaatgtaaaaatgtaaggcttttaatactcattgctaaattggcctttagaaaggctaaccttgcatttttcactgtgatatgtttagtatatgatccatcatgatttacaatattgtagcacatcaggataagccttgataaatcagaagagtataaatctggatatagccagtatcgttgtagatggctcactgcatatatacacgtatatacatatacgtacgtacacgtatatacatagacatatacatatctgctgccatatttttccaggggctagtttgactcttctactttggagggctttgcagtttgttaacccaatctggagtccaggccccggcttcttacatttctttaaatatcttggtgagaccagccttaaaaggaagtatagtctggagagatgcagacatcactagaagatatccttttacgtagagaattttagatttttgcttttaaaaagtaaagacaggctgcttttatgggtgaattcagatctctccctctagcaaattaccaacagctttaaaagggtagtcttcatgtccaacagaaaagctggatgataccctatatttcctattatccatatcaaactccttattttataggcccagttgtaggagtaataacatatccatggtaacatggctggatagtggtgaaattgagcatcaaacccaggttacctagtccagtattgttttcactatgttttatctctccttaaaactgaactttatttctaaatgtgccatctggtgtcatctgtagaaatacaaagtaagtggtcctcttcctatgagaaagttactccccaaataggggaattttaaagtagaaagtcaacgtgagaaaggcaaaaatccaaagaaagctcagtttctttgcccttttaaccgtagttactactttctgacatgagatcaacttggagctctttcatggaacagttcgatttggccatgtgttttcatgcatttatggatgctataaatcagtagatgagactgaatttcctgcttgtaaaactttttcaaattaaagggctgctttctaagtccatcttattttcccttccttttttcaactgttttaaactataacatgtttgctatttttaaaaagattgaaacaaaataatagtttacaccttttagcattatagttaagtattactgtgttaagtatatacttatgttaagtatttttatactatgttaagctttttatgctgaagtaatggtgtgaagtaggtgtgtacttttattttcatccaaatggttagccagtagctcctgtttttcttcctggcaaagtctatttgatctttaaaaatattcttagcttaaaagtgaattatttgcagaagtgtagttttattttttaaaaacctaggaatttgtggcaagtagaaaactagcatggttacttttagctgtttagtttttgaaaataattcagattgttcatgtttaatatttaacatttgtcttagactgaaggcaaagtactacagatagtgctttaagggatcttagttattgtacttccattttacatcatgttggaagcccagaatgtcataaggtcttaaagccagttggtggctgagaactagagtacctttgcatacttcactttcatttctagcaagcatctttcatgtaatagatatgttttaaagcagtagattgttcagaattgtctggtttatttaagaacatttgaaataactatgtgtcaggctgtgtggagcaccataaaatttactcagacagccatttttttctatatgttgggacacctttgtttttaaaggctttgttttacaactttcttatcagtgaactaatttgagcctcataacaaacctgtgaagttggaattcttttcaacatcctggaaagagtttgctgccaggttgataattgctataaataacttgctcttttaaaccatgcaaaagaatctttgtctccattccttccaaattcatttgaaccagctcaaaacagttgagacccagttaaaatttttgattaagtggcatggcctgcacattatttagtagactgtttaccttttgcagaactgtataatttgagaatgaaactggagcctcccaatctcattgtcatcaaagtagagtttaagttgttggttgtctgcagttatggctaacagtatggagattagtatatactgtatgttctccttcatatgcaggtaatgtgtagaaagattgagaaggccagctcttttgcatatgatcagatttatatatctgtatttctgtcttatcaatctgtagaatacctagcataaggtttctgcctttagattaatctggagccaaaagaaatagaacaaatagcaatacggcttactctttgctgggcacaatcctatgagatagacttgtttattttacagaggtgactggactcagagatgtatggcaacttgtctaagatcacacacctagtaaatggaatttaggcccagatctgtctgtttcccaggcttttccattatgctgttgtcctttacttcatttttacttttcttccagtggtagtcttcagcctctacttttttttttttttttttgagatggagtcttactttgtcactcaggctggagggcagtggcatgatctcgactcactgcaacctccacctcccgagttcaagcgattcttctgcctcggcctcccgagtagctgggactacaggtgtgtgccaccacgcccagctaatttttgtatttttagtagagacggggtttcaccatgttggccaggctggtcttgaactcctgatgtcatgatccacccacctcagcctcccaaagtgctaggattataggggtgagccaccgcgcccggccggggaggtttgatctttagagatgctgcttgtttctctgcaaacccaaggacatgagagaattggagctgaataatgcaaaaggggtggaattctgtttctttggtatctggtaccatctttattgtatttgacagtagtctatcatgtggctttgggaaaaaaataccatatacctgtgtttcataaatgaaagggaaatacaagggaaaacattgtcatggctagatagacagtgtcttaactttctttagggcattggttcctaatgttcttcaggtcatagatccttttaagaagccaatgaaagctgttgaccgtcttctgggaaaaagaccaacatatgtaaaatttcccacagaatttcagggtttttgtagtggtcatccttcagtataggatgaggaattctaaagattcctctacacttgtttttctctatatgtcattaagatgtctaaattgctatgttgtttgttcttgtatttcttagtacaggcgtccccgacttaatgatggttcaacttaggattttttgactttacgatggtgtgaaagcgaaacacatttagtagaaagcatacttgagtacccacataaccattttgttttccactttcagtcgatattaagttacatgagacattgaacatttattataaaacgggctttgtgttagatgattttgcccaactataggctctaatgtaaatattgcaagcatgtttaaggtaggctaggctatgatgtttggtcggttgggtacagtaagtgcatttttgacttagatatttccagtttacaatgggtttactgggatataatcccatcatatgttgaagagcaactgtatatatttttctagacttatttttctacacagtggtcaagggtaagcttggctaactgtgtcacttttgcttaaagatatactctgtattatgcaaatttaatttatcttctgtattgatcttataattggttgtgttttcagcctttgggcatgaggaagttgtaattctctttttttgtgtattgacttcgttgcctttatattacgattgcttctaatctattttatttctgatttttttccttattttctacatttctgtacacctggctatctgagtattcatctcaatgccctgcatatagtatgtttataattgttgaatggaaagatgaaggttaaatgaatctaaattgtttttttcagttcaccaagagtttaatgtgacttggattttttttagttttgttaagcatttactggatagttattcatttattaatctgctattaataaatgacagttcatatgctggtacaggaatgcaaagataaatatgatacagtcccactcttgcagaactcagcaagcatagtggggagactgtcaggtaagtaaagaggtgtgctgattgaggatcaatatgcaggatatagttggggctaaataaagcatgtggggagctgagggaaatattatgtaatatcatagcactggtaagagaggtaagcagggaccaggtcctagaggtcttggatgctggtttaaataaggagtttgtacttgatgtaggtaggttttgagttttagggagattgctctggcaacaatgtggaggatagaatggatggatccagcaggaaaaagtctcactttaaaataacttcaatttatgagacttttcaaaacatatacaaaaatagaaaaaagcataatgaacacccatgtaactgtcacccagcttgaacagtgatcaacacagggctattgttctatttataccccgctcctcccctctatttttattaaagcaagttcctaagtcacagaatggcaaagcatatattgaataataatctaatgccatggctctcaaggctggcctgtgctgccaaatcacctgtacagcttgaaaaaaataatccccacttcagacctactgaattagatagctttgaaatgcctgtgtggtcaggcatttttagttttcaaaataagtctcgggtgaagtaagttatttttaagataattttaaaataacttctgacaaatgaaaatactttcctgaactcattgaatgctgcctgtggcccttctgggtgaaattcacctattcgatacaggcaggcttttcttataaatttttatttattttttgtagagacggaggtctcactctgtggcccaggctggtctcgggaaaactcctggcctcaagtgatcctcccacctcaggcttatcctcccacctcaggcttccaaagtgctgggattacaggcatgcagccagaaactgacaattcttaaggtgtagactaggaatattccagagtaccaatttaaaatgtgtagacaaggagtctgttcctctcctgcttaatttgcttaacttacacttaggcattgctgtttttattttttgttgagaataccaagaagggctccttagcatgctgtcatttcctctgtattggtaaaattgataatctgcaactttggtgagccatgtttggttgcctagttcttctgatgccagtttctctaagtaattgggagtatccgggaaggataactcccagatctgcagcttccccagactgtttgaatagaggatgtggcaggagatgtgttctcagatactattctcacgttcaaagtcaacattggaggtttcagattcctctttcttagtatccctccctgcccatattttccttgcttaagcataactgcagtgcagagaaacacccagagccagcataaactcttaatctgaggtatagtgtgttttcagattttaaatgagagactccttcaaggtatttctgcaaataatttccagatttgtcttgggtgagtaaaggctatttttcagttgctttattatgacactttactgtcagtgcccagtaaaacctaggtcagcagttctcagggcacttgagagtcatgttttatgtggctaaggatagggagactggtgtctgtaggagaggggcgtagcaaggtgggctgtgcatatagacattatgtgcaatgtagagttgtggaacagatttgggtttgaatccacgttttaccacttaataggtatgtggccactctcagtaaactgggcacagtcttcatctccaaggattaaagataatgcacaataggtatagagtaagtgttagctatttttttatgatcataaatgtttttcacaatatttgttgagtggatattaatgtattaatagataatcagaaactagataggatggaaaggcctgacaattatgtggtgtcccctttaacaaatcataatcagtgacacctattcctctataatcaaatagtgaatagcaggctggatttcaagatgcatcttactgcttgttgacatgaagaatgctcagggcagctctcacctgaatttactttcagagactataaggcaaaaggaaatcgttgcaaggcaaaaaataaagtattttgctttgtggtactttggagtttagttttctctaagcattttttgtttaagaactgccgtaatgcttccatgatttctatggggattttaggctcattttgattcatccccactcccgtacttacgtgcaacatctcttacctgctaataatcaaccaaagtgcctcctgtgtgccaagctccaaacaccagaagatgtagggaagaagctcctagagtaggcagcagctaatctaaggcatttgtttagatggtgttcttaatctggtgcatgtcctttggctcaggggccagtgttttcttccttaaggaaaattttaggcctggcacagtggctaacgcctgtaatctcagcactttgggaggctgaggccaggaggattgttttaactcaggacttcgagaccaccctggacaacatggcgaaaaccctgtctgtacaagaaatataaaaattagccaggcgtggtagagtgtgcctgtggtcccagctactctggaggctgaggtgagaggattgcttgagcctgggaggttgaggctgcagtgagccaagatcatgccgctgcactccagcctaggtgacagaatgagaccctgtttctttaaaaaaacaaattacaaaaggaaatctgattataaatggatccatgatttataggaaatttggaaggattagaaaagcatgaagcataaataaaactatgtgttaccctgccagctagaggcaaccattaaaggccaactactaataatgtgtatttcttcccttcccaggtttttttttttttttaactttcccaccctgtggcagacattttctcataaatagggaagtgataggtacagagtacaatgtaatcacatatggtgggatatccagtcaagatttgaggggttcgggagaagattgtccaaattctggatatcattctgttcaaacctgcataagtgcttattatattacagtgaaatagaggctaaatggtcccctacccccaattttcaaagggattcttacagttactccgtcttttcaagacagtttgcagccacttgagaacataagctagtgtctttatttaccttttcctctacatttcagtgaccccataattctctgcttccatttacagcctatatatatattttttcccccgagatggagtttcactcttgttgcccagactggagtgcaatggtgcaatctcggctcactgcaacctccgcctcccgggtttaagcgattctcctgcctcagcctccgaagtagctgggattacagacatgcgccaccacacccggctaatttttttgtatttagtagagacggggtttcaccatgttggtcaggctggtctcaaactcctgaccttgggtgatccacccgcctcggcctcccagagtgctgggattacaggcgtgagctactgcccctggcccaacattttcagaagaggtttttacacataccatttatgctttctcactttccattgattccctgactctagtctggcttccattccctccatcccactgaaacaattgcttgtcaaattgtctctattaccaatttcagtggacatacctcattttgacatttgatgcagttgatcactcttgccatctttcgtctctcgtgatagcataattagctagttttgctctttcctcactagcctctccattgctgggttttccttctttccttacctttacacttttattgtattgtattttttttggtagagatggggtttcaccatgttgcccaggctggtctcgtttaaggaatctgccctcagcctcccaaagtgctaagattataggcttgagccattgtacccggccccttctttgccttacctttaaatgctagagcaaataactcagttgcgggcctcctcctttccttctttgtaagcagtcatctccagacccatggcttcaagtaatatatgtgtgctgacaatcacagattttattcttaatgcatacgtctttcctgaactccattctacaaatatttgcatacctatcatgtggaagataccgtgctaggtactgagagcttaacatcttagaaaatcaaaccagtaattacagttgatacttgttatgaaggaaattggaaataaactgggtgctataatagaaaaattacagtgggaccaacttgaggtgggttgtcatggaaagcctctctgggtcttagtttaaatgtcagttcctcaaatggaactagttgtgggaaaggaggggtggcaaaaacattccagcggcgaacttagaaattagagtgttccaagaactaaatggaaagaataattacacagttgaggaaacaagcatagagaggtggatttgtctgcggttatgcagtgagtaagtgatatagcagggattctagcccaggttttctgagtctgtattctgatctagtgcttctcaaactttgttatatggatcacctaaggatcttgttaaaatgcgggttctgactcctcatatctaggtggggcctgaaattctgcaacttttaataactcccaggtgatgtcagtgctgctgatccttggaccacacttgattagtaaggctagtctttcactacatccaactgctcttgagccagatttgggaactacaggtgtcctgtgcccttaaactgattcagtattgaaagtcattatttttaaatattatcaactggaggtgattactatagaatatgagtcacgctttgagtggcttccctcaggatattttagttgtgtacacttgttctgcaggtaaactgtacaaaaccaagattcaaacctcaggggtgtaaggaaaggttgggggaataaggaagtgaaaaaaaatattagataaaagtattgaagtaatggtaatagatatggatggtgattcatagtaattcacttgttttcttttaagttggctatctttctaacctaagtttaggaagcaatgtttattatatatagagattgcttggtgccctgagttctggttctgacccaacaaaggcagtaggccatttctaggaatttgtttcaaactaacttatttttatggaaggatttttttttaaatgtaatagggttttcacctgattaacttctaagaggtagaactcattccccagttactgttcctttcattagtgaaattacagcatctcagcttctcatcttgggccctagtttcctctcttggagtaattttttcaaacaaataggattcagcagtctagaagaatctgtcacaaatttttattcttatctgccaatattttgtagtaataaaactggttttaaaaaaaggtgaggctgggtgccgtggctcacgcctgtaatcccagcactttgggaagccgaggcgggcggatcacaacgtcaggagatcgagaccatcctggctaacacagtgaaactctgtctctactaaaaatacaaaaaattagctgggtgtggtggcgggcgcctgtagtcccagctactcgggaggctgaggcaggagaatggcgtgaacccgggaggcggagcttgcagtgagccgagattgcgccactgcactccagcctgggcgacagagcaagactccatctcaaaaaaaaaaaaaaaaaagtgaatcgcatgttattaaagcatggacttggtagtcagacctggatttagatcttggtgctaacatttactgaccaagaaaggtactttttttctctcttacttcagttttctatctgtaaatagaggcaaaacttgacttgagtggtgaggactgtatgaaaaaatatcatatgaattccctaggtagcatgtctcaaactgtattctttggaatacttcaattggactttgagtagatgccacttgagaaaatggttctgtgcgctaataagcctcctttacctaagatgtcttagagccattaataatgtcaattagctatgtgactgccctagtggaagagaaattctgtctataacatttcccaaattacaggattcttgtctccctttatagagcaagacattctaacacactttggggaactccagtctcagtattgtctggcttgtaatggacactcagtatactaacgttcccccctcccactgttgaaaccagttttagaaatatgagaacacaacaacttctaaatttttaaagttgatgtctcatggacagtgatgtcttggttttttaaactacaaatgtttcttgcagtagaattatagacaccaaggtaggactgcacttgttatgggaacatttgtgtgtgtgcattcatattggctctgttattttattgggtgcatcaaatgcttacacttgggacttagagtctagcgccactcatgcaaataacctgagatgatttagaattatgccaccagcatagtttctaggcatccagagtcttgtgttggcagcagaagtaccccaagctaagctgtttccgtggggggtctggctgtagttccaggctccctagcttccttggttcctcttagttttctgcacgtggagctctagccttctgtcagttctgtgagctatcagatactctccagtaaattacttggctgcattaattatccagtctttctgtagttacagacacttgactagtatagtacactaggtcaaaacagcattagagcaagttgcttatttgtttgaagattcatcagtgactcatctgcattaaaaaagtaaaatggttgtgatttgcttatttcagtgcataagttactctgtgctcttgttttggaggattgtttttttaaaatagactttatttttagagtagttttacattcccagcaaaatcgagcagaaggtacagaaatttcccatatactgcctgcctccacacaggcatagcctcccttgttatcaacatctcccactagagtggtacacttgttacaattgattaatctacattgatacatcattatcactcaaaggccatagttaacattagggtttactcatggtgtatacttttggggtttagacacataataacatgtgtccaccattgtagtatcatacagagtagtttcactggccaaaaaatcctctgcgctccacctcttcattcttccctccccactaaccctcctcaaccactgatctttttactgtctctatagttttttcttttctagaatgtcatgtggttggaatcatacagtatgtagcctttttgtactgatttctttcacttactaatatgcatttaggtttcctccatgtttgttcatggcttgatagctcgtttctttttagtactgaataatactccattgtctggatgtaccacagtttatccattcacctaccaaaggacattgtggtttcttccaagttttgacaatagtgaatgaaggtactataaacatccatgtgcaggtttttgtgtggacataagttttcaactcctttgggtaaataccagggagtattgattgctgggtcatgtggtaagagtagttttgtaagaaattgctgaactgacttccaaagtggctgtactattttgcattcccaccagcaatgaatgaatgttccacttgctccacatcctcacaagcatttggtgttgtcagtgttctgggttttggccgtagtgatatatcatcatggttttaatttgcatttccatgatgccgtatgatgtggagtatcttttcatatgtttatttgccatctgtctgtctgtggtgaggtgtatgttaaggtctttggcccattggcccatttttaaatcagcttgttttcttactgttgagttttaagagttctttgtgtatcttgggtaacagtcctttgtatgtcttttgcaaatattttctgtcagtctggcttgtccacttattcttttgacagtgtcttttacagagcagaatattttacatttaggtctgtgatccattttgacttaatttttgtgaaacatgtaatttcggtttagattttttttttcgcatgtatgtatcgagttgttccagcaccatttgttgaaaaaactatcttttgtccattatattgactttgcttctttgtcaaagatcatcggttgacaatatttatgtgggtctacttctgggctccctaattctgttccattgatttgttcattcttttaccggtacagtactcttacttactgttgtcttatgataagacttgattttgggtaatgtaggtcttctgactttgttcttctcctttgatattgtgttggctatcgtggatcttttgcctcttcatataaattttagaatcagtttgtcagtattcatataacttgttgaaattttaattggagttgcattgaatctgtggagttggaaatgacttaacattttggcagtattgaatcttcctatccatggacttggaatatctctccatttaattgttctttgatttctttcatcagaattttatagtcttccttgtatagaccttatacatattttgttagatttatatctaagtttttcagttttggggtgctaatataaatgttttttatttcaaattctgcttgttcgttgctggtatataggaaagcaattgactttttttttttttttttttttttgagacggagtcttgctttgtcgccccaggctggagtgcagtggcgccatctcagctcactgcaagctcagcctcccaggctcatgccattctcctgcctcagcctcccgagtagttgggactacaggcgcccgccaccacgcctggctaattttttgtgtttttagtagagacggggtttcaccgtgttagccaggatggtctcgatctcctgaccttgtgatccgcccgcctcagcctcccaaagtgctgggattgcagacctgagccaccgtgcctggccagcaattgacttttgtatattaaccttatatcctgcaaacttggtgcaattgcttgttagttccagggtgtttttccttatttcagattttctgcatgtatgatcatgtcatctctgacaaaaagacagttctgtatcttccttcccaatctttataatttttatttcctttactgctttagctaggactttcaatacagtgttggaaagcagtggtaagagaggacatctttttcttttttgagacggagtctcactctgtcgcccaggctggaatgcagtggcgcgatctcagctcactgcgatctctgcctcctggattcaagcaattctcctgcctcagcctcctgagtagctgggattaaggggttttgccatgttggccaggctggtcttgaactccttacctcaaatgatctgcccacctaggcctcccaaagtgttgggattacaggcatgagccactgcgcctggccttttttgtttgtgattatttaagggggaatgctcctagttcctgaccattaagatattagttgtagctttttttgtagatattttaatcaatttgaagaagttctctattcctagtttactgagattgtttgacttttcactgttgaattttgagagttctttatgtattttagatactatatatggtttgcaaatattttctcctagtaaattttattgtcctatatttaagtgattcattttgagttaattttttatataaagtgtgaggcttaggtcgaagttcatcttttttgcctgtgcatgtctgctttctctggcaccatttgttgataaaactatctttccttgactgaattgtttttttttttaacctttgtcaaaaatcagttgggcatatttgtatgagtctatttctgggttctctattctgctctattgatacttgtatatatatcagtactacttgatgtctgtagctatatagtaagtcttaaaagtgggtagggtaattcaattcctccctcttttatttttttccaaaattgtttcagccattgttgttcttatacaacatatacactttagaataatctcagcttatttacaaaaaaacatcttgctgggatttgaataggaattatattaaacctatataacaattttaggagatttgacatctttactagagtcttagatctctccatgtatttagagctttgatttttttttttttttttttttttttgagactggagtctcgctctgtcacccaggctggagtgcagtggcactatctcggctcactgcaagctctgcctcccgggttcatgccattctcctgcctcagcctcctgagtagctgggactacaggtgctcgccaccacgcctggctaatttatttttttttattttgagatggagtctcgctctgtcgccaggctggagtgcaacggtacaatctaggctcactgcaacctccgcctcctagtttcaagcaattcttctgcctcagcctcccaagtagctgggattacaggcttgtccttccacgcccggctactttttttgtatttttagtagagacggggttttaccgtgttagccaggatggtctccatctcctgacctcatgatccgcccgcctcagcctcccaaagtgctgggattacaggtgtgagccactgcgcctgcctggcctttgtttttttaagatggagtctcgctctgttgcccaggctggagtgcagtgagccactgcgcccatcctctgggaggcttttaaaatagatttcttgggttttctatgtggatgatcctttgacatctgcaaatagggaccatttttattttttcttttcttatctgtgtgcctgttatttctttttcttactgtattatattggctagaactttcagcagtatgttgaataaaagtcatgataacagacatctttgccttgttcctaatcttagagggaaagcatcagttatttgagttgtattgaggctggctgctacgtcttgcagcaggggcagtttaatagcctccctgcaaatgactgaagcgacaatagtgtgacagccacttgcgtaagacgtttatgagaaaaggggaggaaaaaagccttgagagtaagcgtacaaatagctcagcttatagtttccaccacatggacaggattgttgccagaatcctgttggcttcatttgagatattttgaggttgttggcatcaggcattttgttcattttgtattgatactgagataactttttaaaaagtaatctggaattacacaccctaaatatcaaccatagaaaacattttttcttcttaaggaatggtctctgcagaaatgttttagaacgtattctgaatttttcacaaactcttccttgaatgcctgctgattgaatggatacaggtcgtacaggcaaatacacgctatttccatagtactgagtatattggactaaatctaggcaaaaagctgcctaaaatttatactgtaattggtcagctttatattatggcagccttctcgggggaggaacattgatttctagtgactgccactgagttaaatacattgttaatagcagaatcttttgtgtgtaaagagcctgcaacccacttctacctctgtgcatgtgtcttagttgctaacaggagaaacttatttcttcttgtgctttggaggacttgtctgccatcaaagatctagggattatacagtggatctgatcaggctgttgtctgcttttgagccttccaaattacatggcttaataaaatgattgttttctgtgctcagaatatttctgttgtgatccttatacttcattttctagttgaaaaaagtgttgttttgcctttgctcttatgatacaactaatacatttttattggtaggaacagtaaaaggtgcataggtaaaacagtcatacttaatccttttggttaacaatgaattaatattctgatgcctagcacctctaagctgttttctttagacataagttttataccgtatgttctgtgttgtaatctttttatttcatcatgaacatctttgtgtattacatagtttgcaatatttttaacagttgtgtgacattccattttaaaccagtcgtattttggacatttgatcttttttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttattttcaattaagagtttgagatgcttgtaaaagagaaaaaattttcattttgacctgatttggtttcagtcttgtgcaacatagggatgtgggccagtttgatctggagagattctttacctctctctacctgatagctgtgcctctgagttggcatagcatcataactccagtgtttttactttaagcattttgcattgctcttcattctgtattgtctgtgtccaagcttgtagagctcaagattgtagctttaagttctcacttcttttgggattttcttttttcagatcgtaaagctgaaaattgaaatcatgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctagaaacagtaagattttcttttgaacttccctggatcaaaaaaatggatagccaagagaccagtggaaagtgaacaccgatcagttagttcttcgtagctgtgtgtgcctgaagtcagctctcaggctgctgtgcaattccttcctatgcagaaaggatgtgtggtataatggaaagagcagatatgggttcagatttttaatgtacttctgggatcttgcaattttgttttttagaaaatgaaagtggtaacatctttcttactagtttttttgttaaggccagtgttttagcttgtctttattactgattcttaatcacacaattcagcttaacttgtgtattgggtggtcatatcaattaaccctttgtcgacagtagaaatcccagctttaatctagtaatattccaccagctagcttgaactgctttctaaggttgaggaagtggtattgcattgtgatagtcctgttgaccccttgtgcttagttcagagagcacaagctttgaaattagacctaggtttgaatcttaccagacttttgtggctgagaggttattaacttgcctggtttccacagctgcaaaatggggctgaaaattttttccttcttgatgtgaggcaattgcttagcatagtatctggcacataagttagttcatatcgtaaatacaagccacttggttttcaaaaaatgtaaaagtacctggcaagtatcaccaaaagataacaataacattttgctgcatttcttccagttttttttgtttgtttgtttgttttgagacagggttttgctctgtcacacaggctggagtgcagtggcacgatcacagctcactgcagccttgacctcccagctcaagcgatgctcccacctcagcttcctgagtagctgggaccataggtgcatgccaccatgcctggctaattttttattttgtgtagagacaggatcttgccttgttgcccaggcttcttccagtcttttaaaaaattattacatgtgcacacacaattatcctgcccttttcatttagcattgtactaatgagtatgagcagcactttcttcatatacccttgtcagtattacagattgtcttttaaatttttgttaatttcataagtggggaagaaagtatttcactgttctatatcagttatcttcttgtgccattcattttgtatctgacattggaatatcagtgtttctcttactgaatgccatatatattgaacgtactcattttcatatctgttggaaatatcttcatttgcttttgattttgtttttgatgtgttttggcatctagaagttttgacaactgtgtacttgaatgtcttttactgaaggacaaaaagaaaacttgcttaagaaactataatttaaaaatttaaagtggaaccaatgtaagaatctactgctacgagaatagaagacctagaaaagtgatcctagtgtatataagaactagatatatggtaatagagggattataaattggaaagaagggacagtattaggaaaccatgctagaatgattatcttgtagagcatgtgggactattatattgcgataaattttagataaaccaaaagtcaaatgtttttaaaagaaataagctataggagaagtagaacatgtaggtgaatgtttactttgtcttaagtgggcatggtctttccaagcattaaaacaaaggaaaaaaaccataatggaaatgttaaatactgtatccaaaattaaaaagacatgacaatagccatcctaataggtgtgaagtaatatctcattgtggttttgatttgcattcccttgatttccttgatagggagcacctttttatatattttaaaactatttgtatgtaaatagacatctggataaatgtctattcaagacccttgcccgtttttaaattgtgttatttgggatttttttgctattgagttgcaggagttccttatatattttggaaattaatccctggaagacattaggcaaagtgaaataagtcagccgcagagggacaaatagtgcatgaatcctcttatatgaggcatctaaaatagtcaaaggtgtaaaggtaggcagtagaatgatagttaccaggaaatggtgggagagagaagggggagttgctgctcagtgggtataaaattataccaggcaagttcgttccagagatctgctgtagaacaacatagtgcctatagttaacagtcaggtattgagtatagtctgccctccgtgtgtgggttccacatttgcagatggaaccaactggatagtaaatatttgggggaaaaaacaataaaaaagaacaatacaaaagtaaaaatagaaattttgaagcaatgcagtgtaacagctatttacatcgaattcagtattgtaatactagagatggtttaaagtatataggaggatgtgtataggttatatacaaataccattgccattttatacaaaggatgagcagcatagattttggtattcatgggggtcctagaatcaatccccagtggatacagagggactactctacttaaaaatttgttacgagggtagatctcacgttaagtattcttaccacacacaatcatgcacacacacgtagggacacaaggaaacttggaggtgatggatatgtttattacctggattgtggtgatggcaacgtgagtgtatacatacatccaaactcacccagttgtatgcatgaattacgtgcagtttttttgtataccatttaccccttaataagctcaggtggggtgggggagggggaagacacatgacaagctggggaaaatatttgtaacccagtgtagttaatattttcagtagctaaatcaggagaaatgaatatcccaatgacaaaatgggcatagggcatttaagaaaagaacaaacccagtaaacgtccagcaagattcaacttagcgggtaattggagaaatgcaaattaaaaaacaatttttaacctagtggattgtaaggggttgctcttggagtcatatactgatttctggctcttatttcctagttactagcaagttacttagcataaactcctagaagtggaatttttatgtcactggttatggacatttttaagacttgagttgtctattttccttgagcagcatacatgattgcccccatttcccatactgtggtcaatgctaggtactattatgaaaggcttttattgatcactttgtgtatcagtagctgtgcaaaggattttttccccagatttggtatctattgaaataaatcactgtaaaccctggcaattgttattgagctatcgaactggcaaatgctttcttatatcttaacgttgtgcttgctgctttctcctgcaaaatgcaagggaccttgatagtctgataaaacagagaccatagtactggtacattaaattgatgccattatgctaactggatcttgtgagcagaaaacacaagcacaccttagatgcctcagacatatttgtgccagagagtcagaaacaaaccttgtggaagcttgagggccttttcacattaggaaagtttctagtggccccagggtttgggaaatattgggatatcccttctaaagtgagagggaagttgctgtaccttgtaccacacactgtgaagaaagaggaacaatgtgtgatgcgtttggattttggagccaacatattggttggtcacatttaggcatgctattttgacctatttactggataacctctaacacatttagtggggaaccactaaagtgttagtaaggtttggatctagaaaagactctgcaaaaggtccaggctatgatacaagttgccctatcacttggacattatgacctagtagacccaggtgactgacttaggtgtcagctaaagatgccatgttgtgcttttggcaagccccaatagaattacaagtaagacccctagattcttggctgtgctgtcctctgccaccagctattctacattcacaaaagcagcttctggcttgctactgggccttggtaaagactgaatgcctggttatgggacataccaaattattacaggatccaaatgttcatcatgaactgcatcttacctacacatcgtaaaattggatttgtacagctgcattccattagaaatagaagtaacacgtttgatgctggacccaagtaggtccagcaggcacaagtgaactgcataagcaggtggttcaaatttccatgttatctatttctgctgcttcactgcctctccctcaacttacatcttagaggagaagaggaaaaagtgcaggcctggtttatggaaggattttgtgccaaggattttacatatatttaattaccatgaacatttgaggtagatcttaataatgcttagagggagaaaaggtttggacttagcttaaagaaacccctgttaggttccatgttgtttcagatgccgaaaatacgtttctcccagtttgaatctcacgacagcattgctggatatataggtacatgttagtttattttgcagaagaggatgctgagattcaaagaggtagcttaccaactacctgattccaagggtcatactctttttaatagtatgctgtctctgaatatttaagctcctgtaatgggagataagtattttatgtatgtggcagacgtttgagtttcatatttgtgaggtagctattaggtctgtttttctgataagagagctgtggcttagaggttagacttgctcatgatcaaacagcttagtaaacatgaagttaaaaagtgaatccagacttgtttggttccagacctctggtccattcccaggatgctgtactgcctttatggagttaaagaacaagtgtaataatcacttctcccagctgccattcattaacggaaggcttctctctcccagcccctatccctttccctccttccactttcagaaacttgactataaatgctcaatccactccttgttacctgacaaatggacccattcatcagtagaagagagcagaaatgtatggaaataggaaccccaagaaagaatggagtcctagttttacgaagttcggaagctgtttaccatcttacaagtgaaggattttatgtaacagaaaaatatagctagtgctaatcttcacctttaattgtgaattcactaggacttttcagtctctgattcaatataacctaccaggcattctggttaactttcagaccatggtatagattccttaattgtttttttttttttttttagatgtttaacttattattgtttttgttgtcagcacctttccaaatagtttgtctgcatctacctttatccaaatccaaggtgggtttttgttttgttttttgtttttttttgtttttttttgttttttaagcccaggtggattgttgggggaataaaagcattttctcatgaggtttccattttaatcccaagagattgtctggcacatctcgttttcttaagtagtaaatcctagcaaaaggaaaattgctgtgtgagcttaagggttccttttctgattctccttatttgcaactccctcattccaaaacatcttttgtgaatacttttcttttctcagcctgcagactgcagagccttaatagacaaactcaaagtttgtaatgatgagcaacttctcttggaactgcagcagatcaaaacatggaacattggaaaggtatgtgaagtcaagctcccaaaagacaggactcaccatactaatacatcattttgtatgctctgatatggaataagaaaccacaatgggatagcctcattcagcaattaataagcatctagcatgtgccatgtgcctaacacagctttaaaccagtggcaaggaaaattttgctggctgaggatggagaattgatttcacaggtgatgcttaagaatctcaatcacagaattcctgtggtttgacaatataagtttgagataatttctggatttttagtttagaagaatttttattagataactctaaaaatgaatttttctgataaaatggattctggcaaggatagttctcttgtcttcgtagatcttagaatgtaaccggagttctccatctaaagacctagctctaggggttttatggtgtctattggtgttagcacatatatctagatgggtatgacaatgaactacagcacttttagctcagagtatgatctttctcatatgggcaagggtgggacgtgaacttgtctaggtgtcatgctcagcaatctcttgtaacaaagctcagttagaaagcacccatgcggcgcttctaccttattcttacatcctctttttcctcccctctccagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagaggtaggggaggttaaagcctgtgtaccctgttcttgactagaattgtgtacatccagaaataaggaaattgctatttctattgcttctttccttttcattgtggagctctgggtttttcattgtcaaagataatagtagaatgtttcttggatatagatactatccttcatagggttgatgggaagattctgtactatcacctttgctttgccttttcaagattcaagaaatgaatgagaaatgttatatatgtattaaagtatttaaggaaatttgcatgaattgatttttgccctaggttgttagagcagccccacattacttttaaattcctagaaatagtttgattttctcatcacattaatgtacttactactcctctaagtgttagtgtgctgctttaaagtctctctgtactctgccacacccatcccaaaatatatattcatagcatcctttgtgtccttgaagagtaaggtaggtgcagcaatcagtgagctttttaattggttaaaaatcactgtaagaagaaattattttctttttatagaagcccaactttagactttttatcatcattagttaggtgccctgttaattttaggtgtgttttcctacgtcttcagtagagaaacagaatcagaacaaacaacttaaaagaaaatggcttaggaaaagaagtgggataactgaactaaaggcctaacatacagagctttaagtgggaggtaaataggcagtctgttgaagatgaaatagatatgctgcccatggaagtccatgaccttcggtataattggcaactggaaatgccttggttcatttctagctatattacatactgattttaattctgaccaactgcttcaatgtattggtgaattttaattgtatttaaaagccaaagtaaggccaggtgcagtggctcatgtctgtaatcctgacactttgggaggttgaggcgggaagatcacttgagcccaggggttcaagaccagtctgggcaacatagtgagaccccatcgctacaaaaaatacaaaaattagcggggcgtggtggtgcgtgcctgtagtcctagctactcgggagacttcggtgagaggattgcttgaacccaggaggtcaaggctgcagggagctatgatcatgcctttgcactccagcctgggcaacagagagaccccgtctccaaacagcaacaacaacaaaatccagagtagtcactcaggttccttatgagcatatactgtactgtaacacttatatgttatataattgccacgagctgttatcgatatctttagcttctatatgaaggaccctgttttaattaatttcaattttatgtttgtcataaaggatacagaagagaacataaaatatctttctttcacaatacttttagtccagttagagacttaatgttcttcttgagtcccacatgtgtatttgtctcttttccttcctgtgggaaaacctgcgcaattttgaaccactatttacgttttttacttttattgcactttatagctaactgccagattttaagctccttggggataaggttgcatgttgtagattatcaaatacatatatatatatatatatatatatatatattttttttttttttttttctttttttgagacagagtctccctctgttgcccaggctggagtgcagtggcgtgatctcggctcactgcaagctccgcctcccgggttcacaccattctcctgcctcagcctcccgagtacaaatacttatatattttttgtattgttgtgactaaacttcttgatagctttgtaaatgttgacaagtacattttgttttgttttcaaggccagttgtgcctgataccttgagctttgcccttttttgtccctttagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagaggtgagtcttgggtgaagagttggaggggtgcaaaaattggagcatatggttcctttcaacaggtgtttcttggagtgttaaaatatattagaatccctaagttaacttcactggcctaattgagttagaactattggtgccctgttttaaaacctaagtattctcagttattaagtaattttgaaggaattctttaatctctgctcaccaaacaaaatctctctgttcaaaagtggcaatttcacttctgaaaggaaagttcaaaattagattcaattctgtgtgagaaggaagtataatgcaataataagatctagatttgagtcctggccctgcttactagcgccgacactggtttcctcttctgggaatttaacatatctacttcagggttgatttagaatgaaatgaattgtggggtactcagtgctgtgatcagtaagtcgtagtgattgtaattgaagccagaagctctcatataaaagttcagctctaccaaactattgtccagtgttcccagaggcaacttcttaatacatacttagctttgagaggtaacccactgttggaaagctttcttagaagaaaagtgttatggctggctttttaaaagcatatttaatgcttacctcaaagtaattcaagttttcaggctaattcaggtgccatgattacttataaattagttttgtataattataaatataacatgtattctgaaaattctaggaaaatgtagacaaaatgtcaatcacctataattcatccctatgagacctcccttaaagttggagcatttttttcttgcatttggaaacacatgtatacatgcatgtgacctgttttcttaagatactgtaaatatttcctcttactattaaaaaccacaaggaggtttaacattggattcccaagtccacagttaaaaggaaaaaggaactattactcaatagatgcttccaaagcactcgataaaatttatctcattaacaaaagcttcatataaactttaagaaaactagagttacctaccagaagtcataatgggggagctgaggcatttccattggattcaaaagtcacacaaaaatgtcagacattaacttctgtcatttacatttgtagtacagatgctaaccaacagaaaagaaagaagcgaagaatacatattaaaagaaaaaatttgggctgggcatgatggcttatgcctgttattactggcacttggggaggctgaggcaggcaaatcgcttgagcccaggagtttgagaccagcctgggcaacatggcgaaatcccgtctctgcaaaaagtacaaaaatccgccaggtgtggtggcacacccctgtggtcccagttacttgggaggctgaggtaagaggatcacttgagcctgggaggtgaaggctgcaatgagccaggatcgtgctactgcattctagcctgggcaacagagtgagaccgagactctgtctctaaaaaagaaaagagaatatttgttactatttgtatgtaggtgatgagtctctttgtttcttggggagataatgtaaaattattataactagtaaaagcacagtgaggtagccaagagatcaatatacagaaacagatagctcttccatgtattaatagcaaccaattagaaaatgattggtgaggccaggcgtggtggctcacgcctgtaatcccaacactttggggggccgaggcaggcagatcacctgaggtcaggagtttgagaccagcccggccaacatggtgaaaccccatctctactaaaacaatacaaaaattagctggacgtggtggtgggcacttgtaatcctagctactcaggacggtaaggcaggagaatcgcttgaacccgggaggcggaagctgcagtgagcctagattgtgccactgcattccaggctgtgtgacaagagcaagactctatctcaaaaaaaaaaagaaaatgattggtgaaaagaccccattcacagtataagcaaatattctgtctgtaaaataagtcatattggctaaaactgtaaatttaagagcagttaatgtaggaggttgtgttgtaataacaatggtggggaaagaattcttaaaatccccatggcataaacctgaaagtaaaattttgaatattgtatttaaaaatatacttcccaacaaaaaacacatagctccaggctactccttaggcccttacactagaatataaatcaacacactgcttccttcatcaagaaaaatgtcagttgtactaaatagtatagttaccaatgtagttaaataacattctggtacaacctcattttgtcatggaccaataaaacttgcaaacaattggtgtaatagcaagcagctggtctgcatacaaaattaggcagcactttgtacaacagaagttaacagacccatggtagattaaaaatgtttaacagtgttttaaaactgaaaagggactgctaatgtagaatatccaaggaactcttccagatcaacaaggatgagcaaaggatatggataggcaatttatagaacaggaaattcatgtgagtagatgcccatactcagtaattagagaaataaaaataaaacaaggtacagctttgtaagcatcagatttgcagaaattagaaaactatataatggtaagtcctggcaggtatgtgaagcaatgggaaccctcatacattgttcataggagtgtagactggttctcatgggtatatatttcaaaggtgagatcgcatcatttccataaacgtgatctctgtcagagtattgcatcatcatttgtggtagtgaggagttggaagcaaccttggtatccatcattagtagatactcaaataagtaaaatgtggcacatgcacactatggagtatgtagcagttagaaacagtggaccaaataatacagcaacattgatggcttctaaacatagtggttagtgcataaaaaagtaaaagcaacagttttcattgctcagtaccatttctgaaacttaaaaagatgtacacaatgcaacatatagtttcaagaaagaaaaattaacagacatcaaaagttatacctttgatagaagggaatctgaatgggcaataatgggacagatacatgaacaagtacagtagtctccccttatccgaggtttcgattgccatggtttcagttacttgcagtataatacaataagatatattaagagagaagccacattcacataacttgtattatagtatatattaaactttatcatcagtatgtatgtatagggaaaaaatgtgtgtgtgtgtgggtgtattatatagggtttgccactacctgtattttcgggtatccactaggggtcttggaatgtatccctatggataagggaaaataaatcttaccagcagtatttaagatctgttagaccaacactaaacctttacttacagatttaaaagatggtctaaatagagacaagtaacattttttaaatgggaagacttaatgtagtagaagccctttaatgaaattaggaccaatgattggtagtttaattattttaaaaatcttgttaaagcaggaaatgtttaaaaagtgattgatacatatgattttttaaaaactaaaataattccctttcccatcttatgtgggccataagacttagtaagaagcagtctgttttctgacataaactacaactataatctgtgattactttatggtgttgcaccgattgaagaaaaggagcctgcatacaggattctaaattttttagagtttacccctgaatctcttcataatttgacactttttattttagcatcttgccttttagatgaatattttgcaaaatattcgacttagtttttgtgaaataattccctttctcatttaaatcagtcaaattgattaagtggaagtctgttaatagcatcaactgagacacagaaataaatgagaaaacactgataatgaatcagggtgagttgctgtatcagataatatcataaagctatagtggttttattataaagccaagtttttatcataaggctttttatgattaagccaagtcttgcagttggcacaggaatagacaatacatctgcaaaatgaaagagtataccttatgttgcttagaacagtgggacagtaggctgttttgaggggaaaatgtgtttagaacttttcttcacacttgacataaatcctaggaacgtatttagaggtaaatacaggtgacttttaagatctttgataagagtttgctaagaaagttaacagacctagaagtcattaaaaatacagctttgatcatgttaatttggttatttgtataggaccacaatagcatctgacagaattcacatcaccctacttttaggctgatacaaacacactaatatttcatactttaattaaatgttctgacaatttaagtagaagttaaaatgcaaactgtttttggtataagtggctcacatatataaagtatcgggtatgtttctttgttttgttttttaggtaattcagatccagttgttgttcttcctttggatgattttaccacagaaaggactgcttaaatgattgcttttttgtccctttgcatttttgacactttttacctttgagaggcttgctactttttgctctgaattgatctaaagagattgtagattggaggttaatttctagtcctggagaatttggaatcttgacaggtgcagtacattgcagcctttggtaatagattgatgtgtttggtgctttgcaataaaagatttttacaggtttttgaggtttagagataattaggtatttagtaatggtacctccaatactaatatccctcattaaaatttaaaaatttcatgtttctctaaaatgtaaaatttctctaaaaacttgacttgttcatgtgggcttcttttatttatgtatttattttttttgagacagagtctcactccattacccaggctggagtgcagttgcacgatatcagctcactgcatcctccgcttcccaggctcaattgatcctcccacctcagcctccctagtagctgagactacaggcatgcaccaccacacccggctaattttttatattttttgtagagatggggtttcgccatgttgcccatgctggtctccaactcctgagctcaggcgatccactcgccttggcctcccaaagtgctgggattacaggcgtgagccactgcctgtccttgtgggcttctttaacaatgctcatagaaatcttggttcatgtcttttcagtcttttcaggcaacttcctttgcaacaaacacattcacttgcatgtgtataagaacctggatttggatgtgaaacctacttttgccaacaaatattaacctgtttctgtgtctgtaaattgggggttacaatatctacctcatagtttttttaggatcagagtaaaggaagtcataaataaaacctgtagggttaatgccatcatgttggaagtacttaataaacagctgtcatttgtagatggatgtcaaccagagaaactacatgccattcttttgtatttgctttcttttaaaatgttacacatgcattattttataagtgcatgcatattgtcacatgattattttcagtacagccttttccctcttggttcacctccccataacctcaaatgtattcttctctatatattatcttcatattatattgactgttgagggtgtttttgtccttcagttacaaatgcaggataccttacatccttgttttcttatttcagaccttgttcaaaaatcactttaaagtcacctgtataactatagggttcttttgatggctgcatagtattccatgctttggatgtaccatattttactcaagttccctattgatgcatacttatatttgttatgaatgatgctacattaagcaatcttatatatgaatttagttactgatacatttaatatgatattataagagatgatatggagatcataagatagagtcccagaaatctcagtgtgactttattggcacttcactgatcagtaatgattttgagcatctttatgcttggccattaggatttgttcttgtgaaaggttttatcttttgtccatttttccatttggttactttttcctactctgtaaaaccatattggagatattagtcctttgtcatcttaaaagtattttttcccctaatcttcatgtatattgtctttgtttattgtgttttgtatgtgatgttttcaaaaatggttcagtcaatgcttttatataaaagattgaatatcgtgttttggtctttatgaaaagtgactttggatatggtgtctttcctcatagtagtttttaatgactaggtcaacccagtgatgtgggctaattgtgaatgtgaacagtgattagttaactacagatgtagggaaaattctccagaaagacttgttgaatcagttgaaagccagttggctggcttttgtgaaggtctggtatactctaggtctagtaaacttgaggatgcatcagaatcactttattaaaaaatatattagtcttcctcacctccatcccacctaactcctgagttgctgattcattaggcttggagtgggcctcagaatttgcattgctataaagttcccaggtaatattaatactaacctgctggtccagggagaaccactggcctagtctattttattaagttacaaacttttatcaaattcttataattccatcttagagagcatcaagcctttttcctgatgtctgaatatttagcaaatcctgtctagtgtgaggtagtgttgtatatgcctctgtggcataatgaatatagttatttatgggttatctacttaagggctaggatgttacagtaacactaccagataggtgaatactgtgaggctcagaagttacttatgtattttttttttgttttttgtttttttgagacggagtctcgctctgtcccccaggctggagtgcagtggcgcgatcttggctcactgccagctccacctcctgggttcatgccattctcctgtctcagcctcccaagtagctgggactacaggcgcccgtcaccatgcccggctaatttttttgtatttttagtggagatggggtttcaccattatttttggacaaaggccctgggctctttgcttctgctaaaatgtgaagaataatatctgttcttcctgtcttaggcatttggggattctttgagcatggtcatgttcgtttttttaaataaaaacaagcttacttagtacttgagaaagcaagataaatagataataaattaataataataagggcaaagaactagtgttattctgaatagtactgactaaaaagtaccctagaatcttaacatttaatatgttgattttgttggcagcgaaacaaacttgtcttcctgataaaaataggtgcttggtgttttatgtatgcaacaaaatttatcataattgtgtatctactcattttggtatattttcttagtctttatctgatgaatatttcttcacaagaaacatttctttatatttcatataatgttactagttcataaatataacaacagcacagactttcgtgagtcacgtttgagttggcagggttttttaaggatctcagcttaccaaaactttctaattaaaggtgcttgttttttatcaagttgcaaaagttggcaagaaggattttgtggtgacactaataaaagtattctgaaacaattagttggaataacagaagaaacaaaaggaaaataattgtgtagatacacagcctttcaagcttattctgccttgcagattcagacttttggtttgacttacctgtctgttctctgtagcatcaagcctttataccctcatccttactttatggttttcagcaaattgcatgtgtcttcgtcttcactagatgtcctgggaagagccaagaaaatattgaaaatgtaatgaagtacttattaggtattaaaccattttataaagctatagtaatttaaatagtgtggtaattaagagtggaattgaccaatcagtaggttccagaagcagatccaatgtgtaagaatcgaatttatggttaagatggcatttcagattagcagaaaaagaatggattattcaaataagatggtgttgtaaaaactggcttactctttgggaggcaattaaggtagattctacctcatcaaagtaaaattaagatgtaataaaaagctgaaatgttaaaaacatgaagttatacaagcattgaaagaaagtataactgcatggttgtatgctgcttgaagtggcaagatattttcaagaatgagactaatgccatgaaagaagaaattgattccattacagtatgattttataccttctgtctgtgaatattttaggtactgtcaattgtgccatctatggttatctcaatttacttcacagttttcttcttacttaggtaatttccagtatttttctgtggtaaataatgctacagtgaatatctttaatacgtgactatttggccatatttagcaccaggtgtttgttaccttttttggggtctcactctgttgcccaggctggagtgcagtggtgcaatttcagctcactgcaacctctgcctcccgggttcaggccatcctcccacctcagcctccctagtagctgggaccacaggcatgcaccacatgcctggctaattttgtatttttagtagagacggggtttcaccatgttgggcaagctggtgtcgaactcctgacctcaggtgatctgcccgcctcgggctcccactggctgagtgctgggattacaggcatgagccaccgcacctggccgtctgttaaacatcttaatgaatgtcgaaccttgtattttacagattcttgtctcattgccttaaacttccctagttgttttaaacttctgattattttttagagttctgatagacttgaattccgacagtcagtttattcactgtttttgtgaaggtgtgggcttatggggttccccattctgccattttcactgacagcattcctagtagaacagtctgtttttaaccagctgggagtgggggatatacatatctgtgtccaggcagactttctcacttaggttttcactagagaagtaagccctaatgccctaaggtatccattattaatgtagcaaagagacttctctcttgtgcatctaaggtggtgctagttatgtaccattatttggagaataaaatgatcattcaccatgttctgtgtttcatatatgatacctggattgagaaatgctgccagtagatcaagtgtagtttgagaaagcttatttctcacaggatagtcagatgatgttttatttattcatttatttatttacaggtttagaaatagcattctatagtatgtacctttgtgactggcatcttcagtggtttacactgtttgtttttgagacttctttggcaagtagtgatataatagcatttaacaaagaggaaacacttagatgtagagagagagccatgttagttcatggtggcagcccagatccgaggtgattgggacccacactagacaggaataaaatgaagacatagaatataagtagcattttgtgcttcaatcatgccagacttaaaaatatgataatgcttggctgggcaaggtggctcacagctgtaatcccagcactttgggaggccaaggcagaaggatcacttgaggccaggaatttgagaccagcctgggcaacatggcaaggctcctacaaacatttttaaaatgtagcctggcgtggtggcagcatatgcctgtagtcctagctgtgtggcaggctgaggcaggaggatcctttgaccccaggaatttgaggctgtggtgagttgtgattgtgccactgcactccactccagcctaggcaacagagggagaccttgtctatctctcacactctcttcatatatagctacatatatataatttttatttttataaattttatataaaatttatataatttacatatttataattttttaaaaatatacaaaatatctttttatatgaaatgttttatatttgtaatataaaaatctcttcagtttgacataacaaattaataaatttgtttcaaataatatctcatttctttcacttcgtcaattgtttgcctgaactatatgccttgccccatgaggcagggagatatatattttttacatatataaatacatattttatgtaatatatgtaaaataattatgaatgatttaaaaataaaaatacgttaatgctcttaatgttaaagtgatattttaaaggctgttaagatgcaggctagttagtaagtgagactatgtggctgaagttttgtatttagaagccagttgagccactccccccattatctcaggagcttgttgatgaggttttagatttgagtggcaaagtacagtagtaataaataaggtagaatctgctttgtaactcagctcatgtcaaaaagagaggaactggaaagcatgatttcctccctagtgctttcctccctagtgcggaaggtgagtaggcagagcctcaggcaaggcctgataggacaggagggacctgtcagcacacgtgactacaggggtatggaatataatggctggcagttgctgcttgagttcttcctaggagcatcctcactgaacagtgaaattgatctcattgaagaaatcacctttaggcagaccatcttgccttgattcttaagttcttatttctgttcgttttttcctcttgtttgactttcacattggatgtcttctcaacattatgttccaagcagccacacactcttaaatatatatatgtatgtgtatatacatagagagaaagagagataaggtctcactctgttgcctaggctggagtgcagtggcgcaaagtcaccataagcactgtcttaacactatctttttcctttttcaagagctggggtggaaaggagaatggctttggacttgcagaatgttgcagagacttgcatatgatggtaagtaactctttgggatatgggtgtcttttgacagagctgtggcctctctgtgaaccttactttacaatgaattgtggtatatgaagtgacgccttcacatcgagacctttgaggaacctaagatcagttcagacatagctgaaccacgtctataggaagcagtctagcagtgcttgggctcttgatgtgctggtggtagataaaaaaatctgagaaatagagtgtgtgttcatacccagttcttgagtaggtagctgtatttgttgaattaattttaatgtgattttttttaaatcccagaaagtatgttcgcttgcattctcacactggaactattgtatcagaactctggacagtgtggtgtgatttaggaatggctgcttggagagcagttctaccattaggtttattgagaacttataatgttttatgtgctttccttgtttatctctctgcctttcacccatgtttaagttatgagctcaggccatcctcctttctgctttgatatgttgctgtggagctacaaaacacaatttgattttcaataattattttgcatctggaagcaactatattttccacgtgggatttgtcttgtcagtttgtcgtgtttagcacaaatggctgcagtgaaatttagtgtatttatcttagcaagcctttttttcctaaagagaatggctcttttctggtctcagaaaaccacagattagatcaagttactttcccacgttagctggcatacttttctttagtgattattttatgaagagatattgggtgatacagtaggtgagtgttgtctgtttaataatcaaaactacataaatcttgaagtatattcagagtttggaattctaattatgacaacataaaggttaacgtgtactttaaaaggaagtaatacatatacatgttaaaaaattcagagtataaagaggtatgcagtggtaacttcttaattttccagaggcaaccactgcaagtggtgtctttcagtgagacattttagtgggcattctgctgtcatcttaattttgttcatcatgttgcttttctagagttaaagagaatgttttgtcagggtctggtttatgttgtcttggtatctacctgtgcagaaaacataccatgagaagtggtgtagaatggtatagaaggaaagtgtttgaagaattatgaagatatgcctatgaggcatactttgaattaaatatttcagaaggctgatgataggtacaaggtttttcgtaggaatgttcttttccattctttagctggtttctgggccctggtatttgttctccatcctttcttggattcttattcattactgcttggcagtcttgcccctcttttcccccttgggaatagccacagtcaaaattgatctcttaaagggaaactggaaatttataagtatgaaatgcagaaggtttgggagctctgggctctgtccttttgattctgtttgaaaagtctcatcctatctgagctctgctctaagacaaacagttaaaggcactgtaggtactgaatgtactgcttattcttctgccacaataagttgaacaagtggctaggactttgagggaagatgtgggggataatgtttataatcagttgaaactcaatgtctgattctttgatgtgctttatacacagaaatatccacccagtgcaactacactacactttgaattctatgcagatcctggggccgaggtcaaaattgagaaaagggtgagtctgattcagatttgttctgacaaagtctacaatttactgtaactgggattgcctcttctagaactcctcagttaaatgaataaatggttttgagctacactgctgccctcgcaaactataaatatacctagcagctcctcaggagtgttaattgcatccccaactctgatagggttgggtcttatgttgggagctgccaaaagatgcaagtcccatccattatgaggcactgctatgacctatgtgcttttcccacagtctctgagaattccaacatgtagtatagtagtttggatggtgatggctcaggtttctctaattaggaagcctgcaaaagtctttatgtattgtggatagtgtcctgcttaaattatctggtcattttgtattgtttgaggaggtactaaagagtttggtttagaagtagcttagtgaaaatacaatttctcttctacctatactattcaataaataaataatctttctagcttaattgccttgaaagcaactctaatacatattcagagagaaaatattttcatgaatttggtctttgctattaatactgctatggatattaagtcagtggagggttaaaaaaggacaaagaagaatatgaaatgtgcctggctatgtgcattatagtttgatactactggttttaaaggagctttcctaagaatattctacatataagatggatgttttggaagattctcaatttaccttgattttaagagcattcacttaggcttcagcctattaggtgacatcttggttttcagacagccctttggagctctatggaaggggaagctagagtgttcagtgactccttacagctctcttgtcttttttaattttagacaactagtaacacactacattatattcacatagagcaacttgacaaggtaagaggaatctttgactcttggctcgtttcttaatgtttggttcactttttgttcctaactatatctttttttttaatgtagatttcagaaagcccttctgaaatcatggaatctcttaccaaaatgtacagcattcctaaggataagcaggtatgatgtggctttaaaacatccacaggatgtggttgttatctaaatagattaatgatatgtactggggtgggagattgcatagcagaaagaatgtcagctttggagtcagaccatgggcaaattgttagcttctctgagccttagtttccttgtcttttatgaggttaacacttaataacttcctaggccttatgagagtttgaggaaaacataaactacctcaccgtgagcaggtaataagtggtggtagctttctgaacacttcggatatcaaaggagaaaacgtttagttgtgttgttttttgagttagccctcataaagaatattcacctttttcattgatgtttttaaaatgtatgtcttatctctctacagatgctgttatttacacacatacgactggcccatggcttttctaatcacaggaagcgattgcaggcagttcaggccagactgcatgcaatatctatattaggtaagagaagaatactttaattaccaggccgtattagacagtttgggcctgatttcctttgaacttcattcatctttgttgctatgagtcctattatagttacctaggtagcaacttaaatacttccacccctcccagtgttcactgtatttattcattatccttgagctccttaatgttggacgagaaagagggtatgatgatgttgattgacatgtcacctgggtttattcttggtattcgtctctttttttttttttttaatagatatgcttgtagctatcgttcactgtccccctactctttctcttgccattgtgtcttcctcctctctcatcctttcagggatatcattttgaattaagtcacaaaatattcagtagtcaatactgtgcatttaacttcttttactgtggcacagtaaaatggaaaacacgtggttttgtaatcagtcctgtactctgtccctgattctgtagattattagccacacttatcctctcagcctcagcttattcgtttaatattgaggtactcaccgtagaggctggtctaaagattaaatgaaaacctagaaagcaatctagcacagaacaagcacatagaagatataaaatggtaaccattgctgttattattgatgttcattatgttatgacttgccttctcttaaactatgagtttcttggcgtgaaattcttgctcttttatgtgtactcatatctagcatgatttctggcatgttagtgggtgctcaggaaatctttgttgaaaactaaatgaatatgcctaaatcccattagtttatgcttcagggtactgtgtccggtattaacctcatcgtggaattcattgaatgtgaattacacacattctgaagttttactacagtgtcacacaaatttctgacttactctgcaatggtccataaattctgttctttacaagtgtttacagtaaaagcagaagcataggaagaggctaaaatggaaatcttatattgaaggcatagtggagttacatcaagtagtaatgttatgaaaaattaactcagagcttttcctatttccatccccaaaattctttctcaagactaataatacctttagtagtggaatctgtcaattcagtgtctgtttagagattatcagttgtatttgatccagtccttcagaatttaatttggtgatgattctgccctccattgctggttgggaatggaattcttccccagaacctatagataccaaaaagtttgttattgggcagtggcttgaccactgccttcttgcctaaagtgtttgtttctccttttgcagtgtattccaatgccttgcaggaatcagcaaacagtatcttgtataatggcttgatagaggagttggtagatgtccttcagataacggataagcagcttatggtaagtattttacaggttgagtaacccttagctgtaacacttgggaccagaagtattttggatttgagacttttttggggggggaggggatatttgcatatacataatgagacatcttgggcatgggacccaagtttaaacacgaaattcattgatgtttcgtatacacattatatacgtagtcttaaggcaattgtatacaatatttcaaataattttgtgcattttaactgtgacctgtcacatgagatcaggtgtggaattttccacttctggcatgcaggtattcccaaagttttggatttgggaatatttcagatttttgaatcagggatcctgcattaatgttctctgtatatcaggcttatacttgtttgccttttggtttttcccagagggttagaaagaactcccagtacttccctctttgggtattaaactgcaaaactaacaaatactagattttcattgttgctctcaacagacctccatcccctcaagcagttaccagtagaatgacttatattttaaagtttggatattagcaactggaacttggttcagtcatcttattatatttgacacattatgtgtttaccttctaatttaataggagattaaagcagcttctttacgaacattaacatcaattgtccacttggagagaactcccaaactcagcagtattattgactgtactggaactgcctcctaccatggatttttgccagtgcttgtaaggaactgtatccaggccatgattggtaagttttgatggtgattatcttaggcaagaagaaacatttgccctctgcctttgtctttttaatatcctgcctgcttaacagcaattttgagcttgtttttgttctccctctccccacctcccttgtagatccttccatggatccataccctcaccagtttgccactgctctcttctcttttttataccatctggccagctacgatgctggtggtgaagccttggtctcctgtggaatgatggaagccttattgaaggtgctgtactttttttttttttttttttaaactacatggggaaatcaactaagggtgtagagatgcaagtttggggtgtttcacagtgagggcaaataatataagaaagcttatccagaaaaagttatacttaagtagaaggccagtttggctttctagttatctaattaacaatgtttaagagcagctacttccattattgagacttttatcatagtgtagaatggtcaggaggtcatgggttctggttaaaacattgccacatgttatcatgcctttacacaaccatagggaaaatatatgtcagggtactttgtaagttgtgttgtagtagtaatagcctttactatgtgcagggcaatgagcaccagcttttttctccctaaatatcttacttaatcctgcaaagtaattgatgtccccattacctcagaggttgagtcgcagaagtcatagaactgtcatttggcaggcaccaaaaataaaacacatgttttcccccatactgtgctgccttactgaggccccagactacatgtatacaaaagcatgcaatttttacaactttgtgtctttatagttcattgtttttgcctctttttctccgtgataggtcataaagtttcttggcgatgaacaggaccagataacatttgtcaccagagccgtcagagtggttgaccttatcaccaacctggatatggcagcttttcaatcccatagtggactttctatcttcatttatagacttgaggtattattatacaaggaatgctttgcacagaatttaatactcagagctgaacctaaggattgtcctgataaccctaaagagcgatcttacagtctcttctgtttctagaaatcaactgtgtatctgcttgcagtgtttttccattataatagtttttaatccctgaaaaaatatatatatatatatatacttgattttcttataacctttctcttgattgtagcatgaagtagatttgtgccgaaaagaatgtccgtttgtgatcaagccaaagatccagagacccaatactacacaagaaggagaggaaatggaaactgatatggatggtaattaacagttattaagtcagtatttttgtgcttgagattttttgtcatcccaccccagttttcattcttcctcataaattccaaagtacacaattaacttgagtatatactttcagcaacaaaaattttttttctatgtaagtgatttgcaaatttgtttttcacaaagataataagaaaagaaaggtactagttctttggagtagagatggcaggtaaagcagatgctatagctgtggtgttaatctgttttatttcatcacgtaattttcttatgtatttcttattgtcttatttctactaaaattcaagctccatgggatcaggatattgtctttttcactgccgcagtgcctgataacatcctaggtgttagaaatatgcttggtagagagagagagactaaaatgggaccttttaaaactttacctattttgagaagagaaaggagaggtaaaaaggttgttgggtaggcaacaacatccgttaggctggcacatcacttgagcccaggggttcgaggccagcctgggcaacatggcaaaaatcttgtctttacgaaaaatacaaaacttagccgggtggggtggcatgcacctgtggtcccggctacttgggaggctgagttgagaggatcatctgagcctgggagtttgaggctgcagtgatttcaaaatgtaaatagtattttatcactgatggagccttaatacattttataaactgtagtcaatgattgtgtatcttatactcagttattcaagtgtataaagtaaaaatgaatgctcacttacctaccatagctactagtttcggtgcggatctttccaggcttttttatgcatattcaaatacatgttgatgttaagtatgtatgtagtattttagaatgggaagatgagatcataaacatactgttcatcttgcattgctcattcagtgtttcatagacattcttccagatcggaatattgagtattaatcttttcatgctttttatatttattaattactcttttgaaaagctgtacctatttgtatactaccaactagtagtatatgaaattgcacattttacttaccactctccccctcttccccaatttggtaggtgagaaatattgaaggacttctgtaggattgttaatttacacacacacacacacacacacacacacacacacacgtgtatgtatgtacgtattaatacatgcaactagtgatatattttcattttggggttcagtattcctgatcttcatttttatattcatttcacattaatggaagaaattttctcaaacaaaatttttctttttgtggtaccttttattctagtaagtttctttatcataacttgtactttagttgcagatgtggctatggaaagcagtccaggctcatccatctctatggagcacaggctggatgttgaattaagggcatcaggttccagcagcagcactaacatctcttctggccccagccctggtcccagtcccggcaccggccccggccccggccccggccccggccccggccctggccccggccccggccccggtcctggtcccggccctggccccggccctggccctggcccccgtcctggtgcgtacacacatagatgtgcagtctttcagagtggtagagttattaaactattgaagaaggcggctttaggcagaacttaaatggtacatttggaggttagcatcccatgactattcatgctccttcaccattctggtgttccattttcttatattaacatgtctttcatagcattttatacttttccaacaatttgcacattgattatcaaaacagccatgttggagggcagataatatccaaaatgggaactgagtgaggtaaaaaaaaagttgaacctttttactttgtaatttttcttttttactttagacttttagtattggtaaaattaaaagtattagtaatttttccaatttcaaagcttaattaagtattcttcctaacattcagagacctcacttcgaatgtcttctaattttattatagtgtatttggatctcttaaaattttgttttatgtgcttgatcattgtggtttaatggcgaactcagcataattcttttgtctttcttcattgccaggagtccagtgtattccacaacgagcagcacttctgaaatccatgttgaatttcctcaagaaggccatccaagaccctgctttctcagatggcatacgacatggtatttgattccagataactttttttggaggatattttactctctcaaagattggttcttttcatactattctggcacctgttgttttacaaggcagtctttggtaaaggccatgccattttcaatagcttttagttgttttgtgtcacttttcctagatgtaagtgttgcttagctattttcataatgatttaccctttttttccccttttccagctttcgactctgtgcttaattccgtcttattacccctttctgactcttaagtgtttgtgttctttctttttttaacccatgttagaaagcctattgcatggacaaataataaaataggaggagacaactgggggccattagattagaattaacacaggctttgaggaccacagtgtgataatacataacatatcactcaattatccccactcctcacacctttccagactattcgtattctccataatgttcacttttcttttagtgatggatggttctctgcctacctccctgaaacacatcatcagcaatgcagaatactatggcccatcactcttcctcctaggtaagtggagttgatagttggttataacaatttgggataacctggcagagctctctctctctgtatttacttacttacttatttacttatttatttttgagacagagtctcactctattgcccaggctggaatgtagtggcgcaatcttggctcactacaacctctgcctcccgggttaaagcgagtctcctgcctcagcctcccgagtagctgggattagaggtgcctgccaccatgcctggctaatttttgtatttttagtagacaaatatgaatagtaaaatcctgcaaggatataaaacacagagaggccgggcatggaagctcctgcctgtaatcccagcactttgggaggccgaggcgggtagatcacctgaggtaatgagtttgagaccagcctggccaacatggcaaaaccccatctctactgtctacctggacagtagacaaatgtcaatagtaaaatcctgcaaggatataaaacagagaggccgggtagatatctgtcttattggtgatgaaataaaggtcagaattcagttttaagtaaatacctattttctgggtgctgaatataccttcgataagtagtacatttgtagtaagtaacattatcatacattttgtttatctgtgctagaattcttaaaacgctaaaggaatttagtaggagacgtggaaatagggaaagtctccttgtagtagcaagcattgtgttttacagtttggggtgttggggagactagttttggctactacaacttagatacttccttgcccccttgctgaagaaatttaggatttttgtatattaaccttgtatcttttaatcttgcacagttcacttattagtacatacttgttttgttttcttagaatattctacataatcttgtcatctgcaaatgcatttttactttgtttatggtctttgtgcctttttttttgtcttatgacattagcaaagatttctgatacagtgctggatagaaataagaatgggcctctttgctttgttcctgaatttagagggaaaagcatttaatatttcaccattaagaatgaagttagcagaggttttgtgttgaaggttttgtcaattttgtcaggttgaggaagtcttcttgtggtgtagcaactctaccatgctatggaaaagctctctgctaaggttatgttcagatggcaaaattcagacaatagttctttggggtttttttgtttttttttaagatttgttttacggtggggacgtctcaaggccaggggcagggagaatgcccgtcttctgggagaaagtccagaacagagagaaagagaaaaggatacacaggcatttttctataaatgggaagcttagaagaaggagcaattgccattgacagggatattgtttaaaagagggaggcagcaagaggatatagtgcttaggtgctgggatagtggtgaggagcaggtgagccctatgaggatgatgccagaagtgagggacacgggcaggaaatgagacttagagcactaaatcaaaggtcagtgaaggtccaacttccttccctatggttttcttaattcatccctcacatttaaattagcatagcaacctcccagttttcccataaaatacacttgtacttgagagagaacaaatttgcaaagcgaaacctaaataattagactagccattgttattttagctccccaaatgatagtacagagcctttcactccaggtggaaggagatggcccaggaaagacatcagggagttctgagaacctcttggagtattttaataatataattggcagtttgggtttatttttgttgaactattctggataccttttctttattaatgatcatgcaacaggaagtccctttaaggcacaagcactatcttgaaatgccagtaggtagtttcatgccagtctgttatcaactatcatagtaactaaactgctttgtccctcattgagggcttcttaggcctgaactgtttggttaatgtggtctgtcaggagttacaacatgtctcggtaacctctatgagttgagtctgtgttacagaattggaaatacctaaacttgtgcccgttacaccaaagattctgatgaggcccagaataggtaaaaagtgctcctttttgtggcaagacttgataaaacagctagactttctagttgaatttgaggtgccctgggcactaaatgtccatagtacataggtcagcttgtatgggtagaagggaacaggatcgctgaataaaatgtataaccctgctgagcaggagttgtaacacagaagaatcagtagcccaagaggttggaagttggagtttctagggggcaaacttatatcagggtggacattctcaacaggggggcatcattgtatgtactatcagttggtggcagaggctgggaaagacatgaaatccttaagggggaagtttaatatggaagcacccagtgaggtcacgatgtcctgcttataatttcacactcaaacccactaaatattctgactccttctccctcacgtgtccgacctctggctcttctatgccacttttagccacctgtatttcatttgtagtatcccatttaacttccccaactcccctctcttctttctcacctcctgccttacccctcatgttatctgttcgggtctgtttgtagcctatgctaatgtcatcatgcttatgattgaccacttaaccagagagtgtagcaagttgtcaatatgagtattgaaatcctccaagggagcaagatatagttgtatgagtagttgcctgggctagggtatctgttagtattgctggaggtttagtatgtaggtggcattctctgttactaatacatagatacaatctatcaggttgagtgaggggaagcaggaaatataggtagtgactggaatagtgaaattagagtgtaaatagtgaaagtggagtgtgggctgtcaaagagttgatggggcagtggagttatgatgagttatgtgggggcagttacaagggcagttaccatcttgagggtgttagcgtcaaggctgggactgtcagttgtactgaaatcatcatctaggatgctttggtatgctggatggatagaagccctaggctcgcacttgagaaattattataaaagtaactcagtatccctttgcctacaagagttttagaataatttcagatagggaagctatgcactgattacccctaaacaagtgggatcacagcatgggcaaaaaggagcccaagaagtttggcattgagctggggtagtagtatcccagacccagaccatgagccaaatgaggtatagacaggccaactagagccagaatattccacaaagatattttcaggcctgtggtgcgtagacttttggcatgccgaagtgccagtttattatgggaatcacaggcattgccatcccatatcctgcaatagtctcccattcaatacctctgtaataaggtggttccagaactggcttcctgtctaagaatgttggtactaggaactaacttaagatttttctttcctctttggaagaaccatacagttgtgtatgtcaacccaggcagagagactaagaccttcatttcctatgaagagggatctccagttagcagtcctttaaaaccatcatattaggaaaggactttggcagagaccttctgcatagtcttagagggtgagggccctcaattttctgtgggtcccatcctgttacctactttcaacctaggctcctgtccaccgtggatcgcaccaatatcaaatgaggaggtgtcgttaagtgagggggattctgtttgggtattatagactcatagatggaaagtatctcattttgaggctagaaaggggacaaaggaagcactaattgtgttttttcagatgtcatacaactaaggcaatcggcaaaagagagatcaatttaagagaccattgtccatttagtaagtttaagagagcattgaacaagccattatgcctctattaggcctgctttctgtgaacagtacaacagatgggccaggcactggctcacacctgtaatcccagcattttgggatgctgagacaggcagattgcttgagccttgagcccaggagtttgagaccagcctgggcaacatggtgaaatcctgtctctacaacaaataaaaatgtttgcagggcatgctggtgcgctactcaggaagctgaggtgggaggatcacttaagtactggaggttgaggctgtagtgagctataattgcacccctgcactctagcctggggaacagagtgagaccttgtctcaaaaaaaaaaaaaaaagacaaatggaagctccaaggtgatgccttgtttgaaaaggcccatgcccagactgaatgagcggtaacgtacgtaccctggtcagagtcggtgttaccagaagcccaaagggaactaactgagggctataatagtggtggtgttggcagtagttgggcaggaaggataagccaagaatgggtctgtataacaatcagttgtgagggcatagcgatttgtgccagcagattggggcagtggcccaataaaattgatttgccagtgagaaaaggagtgtttacctctggtatggtgagcccccactggtgatgatgccgatggcacgacagggcacaaagaacatattgggaggctagggtttgagtagggctagtggcatggggatgcaatggcatttgggcccagggactgtgatgaccttctgccttcctttactctcttctctgtaaccttgactttccaaactctgttggattcattttcagttctattgaagtacatctgtgggtaatttttaaggtgtcagacttctctttcagaagttggtggctgttttcttcattgtattctaatgctacattattgtagataaccatggtgtcacactggttcttgttcttatctgtatatagttcctgcttctgcctttttttttttttttttttttcttctatttctctgattccttttaactttctcctggaaaccctaattaccttttttccatttcttagttgcttggttccacacacagctggttgctctgtgcgtgtatataccctttaattctaattcttggttatcagtgtttttgtataggggtcccagtgcatagtgtcgttgcgacttcttgataaaataacaggtttgatgtcttagtaattgcttgtagaacactaattttagtttttaaatactcaattttagtaactctatagaattcatacatttctacaaatgtaagtcaatcgaggggagtgtcataccaataggaaccccaaaaaggacttaaatttttcagaagtttatagcccatgaggaatcccaaaggccattgaaaactgttggtccccggtaactgctatatatctgccattcccctagcatttgggataaaggagagatgctgtattcaccatcttgaatagaaaatcctctggtttcttttagatcttaggcatcaccataaacaagtttgttctgtatacatggtttatgggtgttgtatgtatattcctcttcatcaggttttttaattaaagttattgtagttattgtagtcttatgagttgggaagctttgtcttaattattcctagaaggtttaataaaactattggcttggtgcctctctattacctggattttttttttttttccccttttaaaaattctggaacgggcacggtggctcacgcctataatcccagtactttgggagactgaggcgggcagatcacctgaggttaggagttcgagaccagcctggccaatctggtaaaaaccccatctctactaaaaatggaaaaatcagccaggcgtgttgggtgcctgtaatcccaactacttgggaggctgaggcagaagaattgcttgaacccaggaggtggaggctgcagtgagccgagattgcaccactgtactccagcctgggcgacagagtgagactccgtctaaaaaaaaaaaaaaaaaagaaaattcttactggtctagtctgctttgctgtcacttcctgagatttgatttttatgacattttcttattaaactatacatttcacttgttggcatatagtttgtagaatatatttttctgtatctagttaaatctcctttctcattcataacgtatattactgctcttttttctaatttatattatttcacttgttggcatacactttgtagaataaattttttttttctgtatctagttaaatctcctttctcattcctaatgtatattactgctcttgtttctaatttatattattgctctattttctataggtttataagcttttccagtgtcttcacaaagctagatattggcttcgtttatcctttttgctttcgttttcactgaattcttttttctgttaattcttcatagcttgtttggttactttttaataaatactttaatgctgtactatttcctcttgagtagagtttttcccatgttccagaagctttggtagttattactgcacattttaaaatattataatgtcaaaaactgatcagattaatattcaaggactcttgcattgctggtgatagtttaaaattgttgaataacctttgtatgaggcagtttatctattttcatcagtaaagcttgcatttgctttaacccagcaagcccacatcatagattttttttcctgttaaaagcagacaaaaacggatatatgtttaggtttatcattttcacaattgaggactggtttttatacatgtggtacatgcatttagtggaatagtaggcagccattcaaaatgaatgggtcgttgtgtcgggagaggacattatacggtatgacagttgtgggggaaaagcaaaatatataaaacagtgtaacctcatttatgtaaaaatatgcccataaaaatcctgtaagtgtagtcactagattctttatagtattgaatctctgatggagcagtattaggatctttaatttcatagtaagcacaagggtttaaattgctagacattgagtatgtatttttttttaagcttttggtgttttgttttcagtttctgtgaggaatctctcagttttccatattttctcatctttttttagctactgaagtggtgactgtgtttgtatttcaagaaccatcactgctctcctcactccaggacaatggattgacagatgtcatgctgcatgcactgcttatcaaagatgtaagtcttttctgctactctgtaaagaatgtcttagggcgtgaaaatcctatctcttctgtgtgtagtgttgaatctaattgggacctggttgtcaaaattccttctatctcagcttgatacccatggccggattttcctagcatctacactcttttagatgcattcaagctcactttgttttctctttaggttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggtaagttgttaagatttattttatagtagaaaattgatttagtttgcaaggaaactcttccttgatcatctctctcatcgttttactggttaggtgtgctaagtttaatgggaattatcatcatacattctattatacttcagaaggaatacttcagcttctctgctcataatatttccatgcttctcaacagttcaccattgtactttcatggtactggtagaaaataggtattaagaagcagtggtagatttccaggttcaccatctggtctgcagcaatgagaaatatggagtcctgaggtgttcatctggtaatctagtgttctgatgtccaactctctaagataacgacacatggatattttttttttactcagtatacttgagaccagataattgagagattattagcaaaaaggtagggctccagaaagattacagttttcaaaaatgtgctttgtacttttcaaccaccactgtagcatttagacactatcattcttaactggagcagccagagggttaatggtttgtacatctttcttctctctcactctgtaatactagtttagatcttgacagcaaagattgccagagtagagtgcagcacacatagttactttaaaatagtttactaaactgattccttccttttccctagtgatttggggggataggggctgggtgtaaattcattaaagaagttgtggcattagaaaatcacaaccaaaaaaaaaaaataggaaaaaaatatcacaacagcctggcctggcacagtggcacacacctaccattttgggaggccaaggtgggcagatcacttgagctcaggagtttgagaccagcctgggcaacatggccaaaccccatctctaccaaaaaaaaaatttctccagtcacggaggcgcacacctgtagtcccagctacttggagggctgaggtgggaggatcgcttgagtccaggagatcgtgacactgcactccagtctgggtgacataaagtctttaaaggaaagaaaatcataaccaggctcagtttcttctttccactttatatgttggtacagaaaagagcccaagctctattttcttcagtctttctaattctaacagttcattttttgccttaaggggatactgcatccaacctggggagtgctgtcgatgagctcatgagacatcagcccacccttaaaacagatgcaacgactgccatcatcaaggtagaaagtgataaggatgtgaccatgagcatgagagagcagagaaggggaaggttttagaagattggcctactagaggtcattaggattcttgggctatagctgtaagagcattatgtctgcctcattgtttccatgtccttaggttggtcctttataaaaagatgttgtcattttagttcatcttagaaagaagtctctgttaaaatttttttagcctgggtgcagtggctcacgcctgtaatcctggcactttgggaggctgaggctggtggatcgcttgaggccaggagtttgagaccagcctggacaacatggtgaagccccgtttctatgaaaaatacaaaagttagccgggtttggtggcgtgtgcctgtagtcccagctactctggaggctgaggcaggagaatcacttgaactcgggaggcggaggttgtagtgagccaagatcatgccactgcaagactctgtctccaaaaaaaaaaaaagtattttagattgagaattgttttccttaaaaatttttttccatttaatgtaacctgtatataatgatttcttttatatattatatggacaagcagacatggcttagattaagtttgtaaagcatattaccctttctagtctccgtttgttgatccctgtggctgccccccacccccgccttattagctctgccagtttccttttagaattgttgttgaaattggtatataagttcctggtgcttggtgaattgggacagggagtcaggttcgtcagtcacttatacagccgtgtgacgctcaacaaattatttaagtttgcagcacttctattcccttgtttataaaatgtaattaatgaccatattctgggaattatgtatataacatgtatacaaagtgtttgggcaaatacacaacacatagaaaacgctctaaatatgttagctgtctcctcctccccattccatgattactaataagtaatcttatttcctgtgcctttcagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcagtaagtgtttacagaacagatcatctagccatataatcgtgggcatgttatcacctctctaagtcttaatgaacactttcatctataaaaagcaagagagttgtattagatcattttaaagttctaaccggttctaagaatgtattagtttttccttttttgacccttgtgtgtcatttgtgctttggtatttaattgtattggttgccttaggaagtgatctttttttaaaaaaattaattaatttttaatttttattgatttttttgagagagagttttgctctcgttgcccatgctggagtgcaatgatgtggtctcggctcattgcaacctccacctcctgggctcaagcagttctcctgcctcagcctcccaagtagctgggattacagacacctaccaccacacttggctaatttttgtatttttagtagagatggggtttcaccatgttgaccaggctaatctcaaactcccgacgtcaggtgatctacccacctcggcttcccaaagtgttaggattacaggcgtgagctaccgcatccggccaggaagtgctcattcttaaaagctgttgatgaaattgaatcagaatttggtccatcaagttaatggactttgcacagagaccttattttccctttgttgatttgatattccacatcgactgcttgatttttttcaggcacgtgtgaaaaacaatgtacttttgaagcctgtctcctaagaagtccttaaggggtgtgtgaagatttgttgttgcttgttgtttttttatttttgttcattttgttactatctgttcgttccagattaattagtagaaggctttggaatttactatatgactgtaaatagtcaagaattgactgcttagatggaagcagggagtttgcttaaaggcttagtgattggtagggggtagtccaccaggctctttgagcagtattcacataccagggatgaactgtaactgtatacctgtaacttttagtcacctgcatgctgaaaatgggattgatctttctggacagtcctgcactccctcatataataagtggtcttttagtgtgtaggtaagtcattctgagaaaagcttgagcattttaggcacagctatgaatgcatttgagctggtcctgaatggcaccttgggacttaaaatttaaggtggagttgacaacaggagcaaaggcctagaatccgaaactggtatgtcctcttggaactctaaatagtgatgagcctgtgggtgtcaagtgttttaaggagaggcattaactactaagtatattgctttgttgaacagataccttaccctgtctgagaaggcaaacctatcttcattctagcagtatcttttgttctcttttaaatgttctttttctagaagaggaggacaccctggaaaaaagcacgacttttttttgtagacgagtcttagtgcttcctttgtcacacccttgaatgtcagtgaccctactggagtgtggggttccttttcctggctacaaataaggaaaaattttaaggtgtaggtggtggtggttttaattcaagctcatatatattcatctgcatgtgacgtccctacctggatattttccagatgccttacatctgatgtgcccagatttcaagctgacacagttaatcagcacactaccctcatttgcttaccctcctttcctttcttgggctatcatgtatcactgtgttctatccacagccatccccattcccacatcacctccttttacatccaccagatttctgtaaggctagttcaaatgtcttattcttgaaggaggtaggttggttggttggttggttggttttttacctccaaatgagaactcaatcttgtgttctcccaacagttttgttaaaattattcatacatgttaatggttttcctcactcacctataagctcctcaagagcaagacattgcctcattcaccagtgtatccctatcactttgtatatagtaggtagtcagtaggtttgtttattgaaatgaataaagagccttaaatgaaggattcctgaagtcttaaatgcttagagagctaggcctaatgagacatgaatgaaaatgaagagaaattagaaatataaacccagtagcattaatattctaccacagtgatagttatatgtaacttctaagatgcagaggactctagtagttactgtaccccagtatcagtagttttctacattctggatgctcatcactgcctcatttggataatccaggagtctcacagatgttgacacatacattttttcacttttgccatcttcagaggcctagattgggtcactaagtaaattattagggaaggaagaaaaagcaagagactgtctaaacttagcttcattttgaaaaccacaatatattaacagcaaaagttctttttatcttctatcccaggcaattgttataggggaattgtgtactttctcacaatatggtgaaagggcttagaaagatttggaatatgtgtcacccttctccccagaagtcttgcccatcccttcctccatatccatagttcttccgaatttctgtttcccatgctctcatttgttttccaatgccttatacacacataaaatgattaacttttatctttattttattttatttatttatttttttttttttgagacagagtctcactacatcacccaggctggagtgcagaggcacgagctcagctcactgcaacctccgcctcccgagttcaagcagttctcggtccttagcctcctgagtagctgggattacagacacgtgccaccatgccttgctaatttttgtatttttagtagagatggggttttgccatgttggcctcaaactcctggcctcatgtgatccacccacttcggcctcccaaagtgttgggattacaggtgtgcaccgccgcacctggccaatttatcagcagtttaaattcaggtatgatttccatacagattttacatttccagtttccctgcccaaaattgagactgttactcatcttacttctgtcatcatattattatgtctattccagaatatgtttaaataaaatgaccatataaagtcttatgtgtatattatatctgacgtatataccttcttgtatctagcttctttgtttgatgtgttttggaggttcatccatgttattgcatctgtcagcaacttgttacttttcattgctgagtagtattctgttatgtgataattgtatagtgattatccattttcctgttgatggacttgggtttctgagttttttccaggcttagacactaccctttctttttttttttttttttttttacaaaatcagcagctagtatttgcaaatggtgtttgtatttactcttgaaatacatggttttgtgctggagatttggagtaaggaaacttaggcactatagtctacgccaggtacgtggggtgcctttctacactcagactcactcaccacaagtagttctaaatacctgtcttttgccccctttcttctgccttctgaattgtttgatctcagaaaatctgatattgctggggatgaatatacttagcagttaagtaaccagggtttgtagttggtgcatcacggttcactttgtggttgattgcattagtgtgcctagcttaccacccaccactcatgagcagcttgaaagaaatggactatataaagtctttgtcatctttagaacttgaatagcaattgtctggaatttaaaggcaatgagtgcagagacgcagttgttccctgaaatgtggcccactgggagggctcctttgtcagagtcagctgtctcctcaaaagctggaggaagcacctgaccatccccccatcccaaaaaaccccatatacatcatactatgacactaaattgatatcctcctttacttttgatgggggcatgagctggggctccaccaccataaatactgaaaattgaccagagtttgggaatgtgtgtatgtttggggaaagggagagagacaggaagtttagaaggacttttcttgaaatcagttggtaagttgagtcctgttggaaagagttgatcattttgattattcctgtatggcttcttgggcctgagagccaaaagatgaggggaaggagaaaagtggttactgaacaaatttattcctgaaattatattaagaaccactattggtttgctttctctctgttcttctccccagtttccatgtagcaaatgaagggggcatataggtctcatttgattttactacttaggctctttgccattatatctggcttcttcaaagggttgggtgtctctgggcgggatccacacctgcactccttatcgatagaggtggatctatataggtaattgatataagtaacatggaatgctgcagtggttctgaggaggaacttaaagaaaggtttgtggtcttctcatggaatcatttcagtcttgccttataggtatactccctttctacaaagttcttccccacatttttcattgaggaggttcacaacatcctacccaaacctggttctgggtatttttgtcactgaagtcattcataatgcctctccactctcttttcctgttctatattctgctgccaaatgttcttgtgcctggcaaatctttgtttacattttgtcttgctcaaagatgagaactactagcttcttgccaactttcttgtcttcttcctctacctctccctctgtctctgccccatcccgctctcctgcaccctgtgcccaaatctgtttcaagggcctgtgtccaaaatactccattttctaaagtatttgttccttcctggggtttatcttagaggtatattttgattcatcacaatatactatatgtgtagttttttgcattgagctgcattttctgcagctgtggcatgttgtagccttctcatctgctgtgcaatattgaagcaactgaaaagacaaaagacctgatcagttttttgatagttcaggaactgtcatgctgcaaataccaattgttagggaagggagacctcaggtgtatgaatctttgaactaaattaaattgtatttcctactctccataactttaaacgtgatgcaaaaacatcgtatgatgtttaagtgtttctttgtctagcctctttcttcaagcaaatgttgagtcttttaattgaacttatttttagtgttctcatgtggataaatttccctaacagtagtttgccaaagataggatagcttctcttgtgatgtatactaatgttgagtttttaaaggcttggttgtcccctttatgctttcaaccttggtcaggcttggaaaggtagattcaggattgatttcagctgtttttttcctgcggtatatgagtctaaaggctcatctctaccccataagcctgggaagcaaaggctgcagtgagccatgattgtgccactgcactccagcctgggtgacagcaagaccctgtctcaaaaaaataagcaaataaataaataaatagaaaaaggcctagaattttatacagtgcctcctcctctgttctcttaatattggtattgtgaatttctgtgtaactcactcttttctcccctaacagggttgttggtacagaggaacgtattcctattcccctcatggattacatccttaatgtggtaagattcaacacagggcaaactgagtaaagatgtatatgtgcttttctggaaaatgtgtttcgttatcagagtccagtaattaccgtattcattttaattggaatccaattaagaggggaaagatgtgccacccttttgtttttgttctagactggtttgccagaaattagccaacacaagccccattattttgtattccagatttttttgttcactgttaccattctccattagaatccagacaggaatctgtaacaggttttgttttgccagtctagtacaggctgatcatcccaaatccaaaatgctccaaaatttgaacctttttgagtaccaacataacactgaagggaaatgctcactggagcattttcagcctgtactgtataatgcaaatattcaaaaataaaaatctgaaacactcatggtgcccaagcatttcgaatatgaaatatacaacctgtaatatgttttccaaatgtgtccaacatatattttcccccttttttcccattacttcctgggtatctcaccaaaaaagtgaagagtttgaattttcccagaattgtttaccaataagggagagacctcttagcatttgtttcagcctactaatcacttccaagacttccagagatagtttgtcttgtgcctgtgtgtttattgcccacattttacttttttactcttaaaaaaattctttgtttgaaacaaactcttccagagttcagtgtttcatttgcattatgcgtttcatttgcattataagcacatttgggggaaattttccatgatgtttgcctgcaggagagaggtaggcaaggagcactaaatagcaaattaagagattaaacatgattgtaccactaattcataatgtggccctgagcaagtcacttaacttctctgttatctcgaaatatctgattcttggtgtgcttgaaaatggagattgggcagaaattgtagatattctttacttcctggatgttttagaatccgtatcatacatctggtttatctgaggttttgatactctatagaaaacactaatatcatgactagaaggctaccccatccttattccaggctggccatttagttccacctgtcaggctctaacttctttaaaaaatttttattacctagatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattggtaagaagcatctggccaaatgttttcatttctttctggaaatcaattttgcgatacttctgtatatatgtttttactatggtctcccttcaactaaaaaataatgaataaatttgtgttatgttgtataagtgaattttgtgactaatatatagtgtgccatgttatttctcattgaaaagtcaaagtattttttctttgttcatcggttgggtatgtagttctacatcattagagtttattggagggaaaagtgtatctccaagaaagcttttctagttgggttttattagtacctctcccttctttgttataggtgcattttaaacacattttatgtttatggttatgtttaaccatgtattttcctcccctttcaagcttggtagtcatgtattttaagcataattgacatgtagttcattgccgatacttaattccccccttttcaagcccgatagtcatgtattttaagcataattgacatggtagttcattgctcatattttgccaaaaatgaagcttctttattttttcatagtggtaaactacacataacatgaaatgtatcatcttaaccattttgaagtgtagagttcagtagtgttatgtgtattcatattgatgtgcagccaatctccagaactcttttcatcttgcaaaaatgaaattctgccattgaacttctcatcctcccctctccccagaccttggcaactaccattctattttttgtctctaaatttgactactctaggtaccttatataagtgggatcataaaatattttgtatgtgcgaccggcttttttcacttagcataatgccctcaaggttcaaccattatgtagcatgtgtcataatttccttcccttgtaaggcctaataatattccattgtgtgtatataccacattttgtttatccattcatctgttgattgacacttgggttgctttctccttttggctgttgtgaataataatgatgctgtgaacatggatgtacatgtaactctttgagactctacttttaattctaattttcccacatcctagccaatacttattttctgttttttgataatagccattctggtgggtaggaagtgtatctcattttgtttttcactggcatttccctaatgcatagtgataatgaacatcttttcatgtgcttgttatccatgtatatatcttctttgtagaaatgtctattcaaattcattgttcttttttaatcgtgttatttgttttgttgagttgtaagagttgtgtattcttgtacacgtattaatacctgatactaatttcttctcaggtatatgatttgcatatatttttcctgttctgtgagttgccttttcttggttgtctttggattcacaaacatttttaatcttgataaagttcagcttctctttttttgtttttgttgcctgtgtaaacacctgtgtttttggtgtcgtgtccacaaaaccattgccaaatccgatgttttgcagctttcccactgtggcttcttctaggagttttataacttagctcttatattcaggtctttaatccattttgattagattttttatatggtaaaagtctgtcctttcctattgcatggtcttggtacctttgtcaaaaatcatttgaccatatatatgtgaagatttaattctgggctctctattctattccattggtctttacgtctgtctttatgccagtatcacagttttgatcactgtaactttgtaatagaaatcaaaaagagtgagacctccaaaaatttttccccaacttgttttggctatttggggtcccttaagatttcatataaattttagaagggatttttctatttctgcaaaaccaaaacaaaaaacagcattggaattttgatagtgattgcattaaatctgtgaaactcctttgttagctgggctgcagagtgataagtaattcctgctgaatgagaaatccatttgcttacagacttggaaagatccataattgtgacgtgacttcatttagtttattttgttttactctttgaaatattgaattaaatgctcttcatcacagagaggggaaaatatcctataagatgctgtggaaggatagatagatttatttaaagccataggaaggcacatgatttctcctatctttgcatggcaagtgatggtgttttattgtcagatttttctccagacttgagaggaaatcacaagggtcgtataatccttgggttgtctgataaaaacaaattgcctacctgattcctatctcagaataatcgcttttgttttaagaagaaaagaacagtgtaatagtgactcacttccatgctttggaactttgcctaacattgtttcctatcgagcaaaatttggaattaatcctatagtgtagaatccttgccgtaacagtattcagtttgaccatcataagcttttaagtgttattggctcaccaagtttgaaagtagtgtgttgctctagaaagagatgttaaggtatgttgtacctgacttcatatttgggttccaccatttaccaggtgagagaccatggccatatccaaaatctgagaggcttccatttaattgtcacttccattgtgactattaaaagacatgatgaatttgaagttcattgtatattaacactttaattattcttcctgtttcagacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacaggtaaaaataaccttaggggtgaacatattaatttaaaggcagtgaaatatctagggcatacacctagcagggttactatgcttgaaaggaggtctgcctgaggtagcagctaaaagaacagtccaatttaggatgagatttttttgactgtcaaaaagttgagtgactatataacttattatgtgatgaagtggactttcttgagagcgaaacatgttattacagacaaacatcaattgggtattcatctggccttagtactttctaatctttccaccagtccttataggtctgataatgggatggcataggtaggacattttaccaaagaacatttaaatcaatagtaattaacaaattactaaaaattttctacatatcaaacgtttgacctgtaatccataatccatagttccagaaagaaggcattttgtgtatgtcctcacagttttactacatttattcctcagataattgattctaaagatttatggtatcaacattaaacaaaacagggttcaacagccctgttttatgctattgagcaggagtgtgttctctgttaattgtgaatcaatcaaatctgaagtttaaaaaagcacaagtataaaggatttagaaaattaaattacttaacaaagcttagggattgatttttatgacttctttattaaatgaaataaaatgaaaatgaaacattcaaggaattaaataaatctaggtacttactgaagtaaagaaattgaatggaaataataatacccctaccaaataatttagaaagtagttaatgaacctgtaaaaccatttctttgattcagaaaaaaagagtagcctctgatgcctttctttcactttataaaaaacaatgagaacggatgttgtggaaatagtttgtaaatattgtaagaggataccttgtggaactgtcgtcttgagtgtggacattttgatgaggtggataactctgagaatagcaatgaagaaaaatcccttacccttataaaactgttgaaggtcaatttttttttttaagtataattgttcagagaacatcccaaaggtgaaattcttgttatgattgcagagtgaaattcgttccatctccgtaaaccagtggggctctcaattgggtctgagtgttttgagcaagctgagccagttatactgttccctggtgtgggaaagcactgtcctcctctctctgtgtaccccaaacaggtaagagaatggctctctctcttattactttgttatctaagttcggtgagcctggaggattgctttggttggggataggagggtatggaagagagttcagaggcctccttgtccttccctcttcccagcctaggaacttgatgacaaatgctttgtcgtcatggtagatgtttaaaatgtgttcctgttattagccagatacaaaaaattgagttgtggctggacacggtggctcacgcctgtaatctcagcactttgggaggccaaggtaggcaaatcaagaggtcaggtgttcgagaccagcctggccaacatggtgaaaccccatctctactaaaaatacaaaaaattagctgggcgtaatggcgggcgcctgtaatcccagctatttgggaggctgaggcaggagaattgcttgaaccccggaggtggaggttgcagtgagcccaagatcatgccactgcactccagcccaggcgaaagagtgagactgggtctccaaaaaaaaaaaaagaaaaaaaaaagaattggaaagcttgtggggtgctacctcaggaattatagatgctttattacattcagtttaacctgcctgctataggagggatagtgtcagccaagcaaattagagaccatttacaatataagaggtgaattatcagtatatatatatatatatttcttttgctcagcatttctctttttgcagcctaccatctgggtgtgaatttggccaggcagatatgcagaaactggttccaaaggatgagaaggcaggtacgacccagggcggaaaaagatcaggtaactctaagaaactaaaatgttagtcattacttctaagttttgttcctacgtctttataggtttattatgaaaatttttagttagttctatcatccatagtctagttttcatcctctcactaatttttagtcatttcttccataaaaacatatatacataatggtaaaatttagaaaatgtagttgaaagaattacccgtatttctgccaccaaaaaaaaaaaaaaaacattttggaagtgtctgcccgtcttttttctctgaatacatttgccagtgtcttagataaaaacatttcgtagatctctttcttcacttaatgttaggtaccatataaaggtacacgaattaactattccctgttaagtttctaatatgctatttttaaaaaatgaacatttttgtatctacttttctacaaatgtaaaattgattcctagaaattactgtatcagagggtattaacaaatactttttaatgtggctactagaaaatttaaattatatatgtgtttcatgttatatttctatcgacagtgctgttttataaagaagattgcttttatattatctcatgataaaaattccaaattttggccgggctcggtggctcacgcctgtaatcctagcactttgggaggctgaggcgggtggatcacctgaggtcaggagttcagaccagcctgacgaacatggagaaaccctgtctctactgaaaacacaaaaaattagccgggcgtggtggcacatacctataatcccagctactcgggaggctgaggcaggagaatcgcttgaacctgggaggtggaggttgcagtgagccgaaatcgcgccattgcactccagcctgggcaacaagagcgaaacaccgcctcaggaaaaaaaaaaaaaaaaattccaaatttcagtaagtagaaatcatacacaattttctgactctaatgctacaaacctaaaatgaatacaagcaacttttccagaatgttttttctctggtgttcagtatcaatgaggaaataaaaaaggataaactattaagaaagcaatgaagataattctgtgtataaaaatgcatcaggccaggcacagtggctcacgtctctaatcccaacactttgggaggctgaggcaggtgaatcgtttgagcccaggagttcgagacccgcttgggcaacatgacgaaactctatctctacaaaaaaaatacaaaaattagccggccatggtggtacatgcctgtagtcccagctactagggaggctgaggtgggaggatcgcttgagcccaggaagttgaggctatggtgagccatgagtatacccctgcactcaagcctagatgacagagcgagaccctgtctccaaaaaaaaaaaaaggtatcaggcttaaaacttgtacagaaattactagaaagggaaatttctaaggaactaataaagctgacataggcttagaaccaacaaacaaggacttacatatgacagctggttattgtgagggatgggataacattaataaactataaagaaacctgacaaaatgagaatttcaaatttagtcaaaacatactaaatttaactcagggaaagaataaattgactaagaactgagaatgaaattagattcactgtcaaagaattgcctctctaacagatatattttttctagcaatttaacacatttaacaaaaacgactcagcttctccacagtttttctggaatgttaagagaacaacttggtgacttgttttataagtttgcataaagctcattcttagatctaagagcaagcatataccaaagaaaaagacacatgtcacattcatatacataattcttaaatgctaggaaataaaattgtccagtggtaatctgtgatgtctagtttgaacttaacaagctataacattctagtagggcatccacattgacagcattgggtactgtgcacactgtagtccatgtgaatggtaccccctgggttgggctgtgcctacaacagtcttccaaggtagccctgggttaatactattcatatgctgtcatttgaagatgtcagcattaggtacttagaactccagaggagcatatcagtaaaatatttgggtcgtgtttttgtttttcaaatttaggaagccatgggaattgaaagagtaacaaaaaccataggtaatcttgtcagtacttctcaaggaaccaggtaaatgttggctctacattgtcctattgctcccctcttatacatctgtagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcaggtgagtcattctcctttctcctaccttttctggctttcagtcccttagtcttgaaacagattgagttggaaaggctatgttgtttcacctaaggaagtttaaaacttctgtgactcatttttaagtgtcctttgttgagtggctgctatgtgacaggctttgtactagctgctacggatacagacatgacagaatcccttcctgagagccatatctactaccctcccttctttaatttcttcctcctacttactcttcaactattgcatattgttgctgctccttccatttcactgagatgtctcagcaaggcatctacaacgtccttgtcctaagtcccttctcacttgtctgcagcatggtagttgacccaccatctccatctagaaatattcttcctttggtgcttgtgttattaagctatcttgattctcggataactatctggctcttccacctagtcttctctttttgtgttccttgaacataactggcaagagacatagtctgataggtgttttatattaaagtcactttggcagctttattgagactgtattggcagcatacaaaactgcattaatgatttgcactggtctgtttgcccttttttttcccctttaatgtaataccaatgtttgggaacctatttgtgtgttcgtaaattgtcgtcactttctggcaccttaatatagaggaaaatggagacctaacttagaggaatctggggcccttcgtaaaagcaaacagaaaatggcctttggtgtttccatttgttacctcaaattcccattgcattttacattttacttttaattagtttaattctccatttattttaatttgaaagtctaccaacattaccttcaaaggaaaattgaccaagcaagaagatgttcatatttctctctccttgctttgtcatatttctttgatcttggagcattcagaggtttctgtgtgaacccagtccatatactgtttctctttggttactggccttttgccatcctcttgtctttggactacctttaagcactttgctatctgttcacctgaaagcagtggtgagaaagtgtaaacccaatgattggattcattaggttttcaaagtctgggtatacccatatctgtagactattccctaattaggataaagaaatcttaatttggatgtaataggaagaagaaaggactgttttccttgttcctatactgtatacatttgagcttattactaaattttagcaggatatgtaacctaggctcaagtagagcctatttttacacactgagtttatatgtgcatgtatatcctgaaaagacatagatttaacccttgagcaacatgggggttgaggcaactcctccacacagtcagaaatccatgtataacgtttgactccccaaaaacttaactactaatagctatctattgaccagaagccttaccagtaacataaacagtcgatggacacacgttttgtatatgtattatatcctgtattcttaaagtaagctagataaaggaaaatgttaaaatcttcagagaaaaatatatttactattcattaagaggatcatcatagaggtcttcatctgggtggtcttcacattgagtagctgaggaggaggaaggaagtggggggatgttggtcttgctgtctctgagatagcagaggcagaacaggtcaaggaggtagaaggaaaggcaggtatgcatggtgtaactttgtggaaatacacagtactttctttctgacttggttgctttttcatttctctaaaaatgtgtctgtacaataccaatttttcttccaccgtttgctttagtttcggtgcccatatcatagtaaggtccacatcataaaaagtcaaaagtattctttagtaatcagaaccctctgccagattgtcttatgtcactttggttcctggcactgcttctacatcttcttcctcatcatctggtatcggttcagaagcactcatctctatcaagacgtcttctgttacttgctctggtgtggtgtttattagctcttgaatttcactgagattcatatcctgaaattcttcacccatgaccttttttttgctatatccacaaactcgtgatttccttgattggcgctgtcataaatcctgttaagttctgcacaatatcaggacagttttctccaacaggaatttatttcaggcttgatggctttttctgtgacaatgatggcatcttcagtggtgtaatccttccagactttcgtgatgttccctctgtcagggttctcttccacagcattaacaatcctttccttagagtactgtgtgtaatagccttaaagccccttatgactctctgatctagaggctgaattagagatgtggttttggggggcaagtagaccacttcagtgccttttgtgttgaattcatggggctctgggtcaccagaggcattgtctaatgtcaaaagaactttaaaaggcactcccttactagcaaggtacttctgacttcagagacaaaacatcaatggaaccaatccagaaaaggggtcttgttgcccaggccttcttgtacaaccaaaagaccagcagctggtagtttatctttctccttcaaggctcggaagttaggagctatataggtaagggcagtcctgattataaacccagtagcatttgcacaaaatagaggagtgagtctgtcccttcctgccttaaatccttctgctcacttctattccttactaataaacgtcctttgtggcctttttttttttttccttcaaagtagggcacttttgtctgtatgaaaaaccctttcaggcagataccctttctcaatgatgttcttagtggtgtctgggaacttatctgttgcctgttggttggttgtcagaagctgcttctcctattatcttgacattctttaagccaaatctctttctaaaattatcaaattatcctttactggctttacattctccagctttagatccttcactttccttttgctttaagttttcatatagtgagttcattattttcttgaattgcattagaatctatagatttgtctttattatggcaatcctgtacccacataaacgtgcattttcaatatgaaataaaaagatttcacaaaagtgcaaggttttcaagcctgctggtgtagctgcagcaacagcttcactaatttccttttgtttgttttacaatggtctttacactgaattcatttttcctgaagtggtgggcaatctgcaatccatatcaaataattcaactttttcttgaagtgtcatgacttttccctgcttcttgggagcacttccaacgtcactagtgacacttcatatggggtcatagagtgacccaggtttattccaggttttcagtattgcggtaaacatgaaaaacaatgcgagaaccatgagagatcactacacaatttactggagagatgaactgttcatgtagaagtgcttagcctcacacagtgttttaagcagattgtggcaacacttgagctcaccacagtatcagcaggtcgtggctacaaaattattacagagtataatatgtactaaattttatccagttactcaatactgcttatttactgcaaatggcaccgtgtataagtgtatgtgcataagtgtgataaatattaaatttttataatttgtgtatattttatggtagtaaatgataaaatagactagtatctacatatattttatgcgtttatgacatacctaactttttgttaatttttcaatattttgaggctacatgtttcatctgagagttttttcaaattgtcaccaatctccaaaattttcagtatatctattgaaaaaaaattcacacataagtaggcatctatagttgaaaacctgtgttgatcaagcgtcagctgtactttgattcagacctagcccttcttgtctctggatcatgaaataacgtttcatgaaaaaacgtgaaataacgtttatttttaaaatgctatggcaacattttcatttatgattttaaaagtatatttcattgtagaaatataaaaacacatgaaatatttaaagagaagctggaaagcactcagttttttgtgttttcttttacatatgtttatatttgtatgctgccttttccttgttgaattatatattgaaaagcatcctatgaaatggaaaatttgagatgtccataatctgcccaattccttaagaagctacttgtaaaaattttcctgcttttcctagtttattttttcctctgggactacatattttttgttgtgatcagactatgtatattgtcagtgatcttttcttatctaagtggctaatcatttttggcattttaaaagttttctgtaggcattttaagtgactttatcatccactagatatcatttaacttaaatatggtttcaatttatgttcctctagcagtatgagtgcttatttgtcttttacatttggtatctgttgagtgccacatatctgtctcctaccgtcaaaagtggcatttgttccttgtgggacttcctttttggattattgaatgtagaacaaatccaagtgttaactaggggttgtaggaggaagtggtgagtcataaaaatatgttaatggtaatatgtctgttgtaattaaaccattctgagaatactgtacagtcttattctgatttctgggtttcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggtgaagttcagcttgagattcagggactagaaagttacaataaaaaatatgtaagttgttcctatactacttaaaatggagtgtgagccactgaatttgagaatttggaggtcccttgtttactctagaaaatgaagtgtaagttacttgttttggttgtacctagtacagaacatgggtaatattttaagtatttacagtcaaactgcatttcagtggtcttatataggtagtatcccttatccaaaatgcttggggccagaaagtgttttgaattttggaattttttgggttttggaatatttgcggaatacttatcagttgagcatctctaatctgaaatgctcccatgaacatgtactttgagcgtcacgtcagcaatcagaagtttcagattttggaacattttgaattttctgatagggatactcatcctgtattctttagtaggtgggaggtgtcacttcagtgtgtaaattttactcttgccttttacatgaatttcctattgcttctgtctctgctttacagaaggttaaagttttgcctttttttccactttcaggctgacattcttcatctgttcagttggtttcacatccccaatgctgtttgatgagaggaagtatccctaccacctcatgctgcaaaaatttctctgctccggaggccacaatgctctttttgagtaaggatcaagttgcttcacagaggagcatttcttggagtttgatctttgctgtgtgccttcccagcccactgcttttaagtaccctatcttgtaacagtgggatatatagaaatagctattggttgtatccttcagtgttctgggaagtaaccatgtttgtctccatttaccttggagggtaggatttagcctcccctagagttgtgtttgtaagggtctctgctttttctcatgtggcttccagttccaagtatgggtttttaaaataggtttgtctttttctgttgtttctctgaatataatttttctgctattcttggtcagatgatttcaagatgagtttcactggtttaggtttttttgtgttttttttgttttgttttgttttttgttttttttgagatggagtctggctctgtcgcccaggctggagtgcagtggcgcaaactcaactcactgcaaggtccgcctcccgggttcatgccattctcctgtctcagcctcccgagtagctgggactacaggcgcccgccaccacgtccagctaatttttgtatatttagtagagacgaggtttcactgtgttagccaggatggtctcgatctcctgacttcgtgatccacccgcctcagcctcccaaagtgctgggattacaggcgtgagccaccgcgcccagctggtttaggtttttaagactctaaaaagtaacggaggagaggcggaacaaaagaaaaaaatagtatagctgaaaactgttggacagattagacgtaatagctctaagaagagggacgtgtagggccaatatagagattggggaccttttagatgtaaaccccccttgccagggtaaaatactaatattctgtctacttttccttatttgaatttagaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagtgagtattcagtattctaaaatcaaaaggaatttctcatgctaagtcgttcccactctattttgtcctgcttaatgaaataacatgcttatttaagaaccactggatccaactcccagatagggctgccttacgtaagggaatatagaccatttgagaattttccgtgataaacatttgagctgtaaatttcagattggtacttgcattaggccgttcttgcattgctataaagaaatacctgagactgggtaatttataaagaaaagatatttaagtggcccacagttctgcaagctttggaagcatggtgctagcatctgctgggcttctagggaggcctcaggaagttcacagtcatggcggaaggttaagtgggagcttgcatgtcacatggcaggagccaggaggtggagggggtggtacacactaactcactatcatgaagacaacactaaacaatgagggatccacccccatgacccaaacacctccagcattggggattacaattcagcatgagatttgggcagagcaaatattccaaactgtatcactgcttaaggttgagtaaaatgcctcttctctgtgcctccttagacctcctcatgttggccaattattttgttgctggtactagttgtggaaggactgttccataggtctttaacttaatccttctgagctttgaattgaagcaaaatgattttcacacacttttcaaattacttacaggcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacaggtagggtactggcctcacactccagggtccagactttgcacccaatggagtgtgatgcttacggattttctaagctcacataccactgagtccctggtcacattaaccaggagacagtttagatttcctccttctcttagtatttattttttttctcctgaggaaaactggagtatagtcctgatgctctgcacaggtaatactcctttcaagcatgttgatgagtattctcagtagcctcctgctgcctcagtggaggcaaactgtcctcagttactttctggttaacctgtaaagagaatggatattgtgaaccagatttattctccaacaagagctttctgaaaccttagtcacctacaaaacttttgttttcacttgcaaataaaatgtataaggggcattttaaaaattgggaggccagaaagaggagaggggaaaggcatgtaaagtcctgccacttccatctcaaagagcattttaagattttcttcctggagtttgtatgtatgtgtgtcagcttttatgtctggagtcctgttcaaatctgtctactatatacacttgtcccgttttttatcattaaagtaataaatactctcattaccaaatttggaaaatacaagacttttaaaaggcattcgtaattttatcacacaagatagtcattgtctcctttttcagtcagtcttgtgcctaatttttacgtcgttaacatcaaataatacatatacttgtattgctgttatcaagaacttttttttactaattggtcattcttttattgttggatgctaattttcttacagtttgatgttttaacactgtgttgtatagtttccttacgtaccaatccttacatacatctcatgattattgcctggtagtagattaactaggtcagtttttcaggcacttgctctgttaccagtttgttttccagaaagttgggaccaatttatacttctttgtatgagtctcaatcttttaattataataaccctgttaatcataataaccatgcatccccccctaactttcttagaggatgaaatcgagaatcttcttggctccttacccaatgtgtagcttagaatgctatagaagcaccaaacagaaaggattgttcattttacctaattgccctagctcataaatgctctcagcccagatgaagttagaaaaagttatttccatcttgaaaaggttccttccttttaaaaatgtatttggatttccgttatgtgattctgagcccttgcattctttatgtagctcatggacatgggcttcacaagggaacatgcaatggaggcactgttgaacaccagcaccatggagcaggccacagagtaccttttaacccaccctcctccaatcatgggaggagttgttcgggtaagttggctcagaagcagtgattttccaggatattggtttgactgctgaagtcctttttccccttattattctgtcattggtcttcctttctataaactgcttctcattttcagacatgtccatgccagtattttcttttcataataacagaagttttctgtcccccagcaatacaaattactatactttgtttgcacaagaacccccagtcacaaaacaatagaagaggcacacttttctaagatgtagaatagatgatcacactgtaagcctccttcctatacttagttttacgtgtgattttcctcatctgttcttgtttgtagtaaccacataagcctgatagggtttgacttatacaagagcagcattttgaggcccttcctctctctttagcttgagcacaagatgtctgattgcctgtgagttgcagtggtcttgttgggtttctttgttttgagtgtgtatccttactggatattctcttaacactctaggatctcagcatgtctgaagaggaccagatgatgagagcaattgctatgtctctgggacaggatattccaatggatcaaagggcagagtcacctgaggtaactatggaacactgcatcctaaagggcttggcacatgaatcttagtattctgtgaacattctgctagtattgcaaactaattgatagaattcaaatctaaaggaagacatgagaagagtactaattcatcccagctttgccatccattattgagctaccttgtattgacctgaagctttaagggaggcatatgaagcgttaatctttattgtcaaataagagacccaatgtgtactcagtagtgccattaggccgaacttggctgtatatttctaggtgacagttactttaattttccctgctggcacagaatatagaacagtgtctagaaatgattttgcgggaggtagtatagaatgctacaagtgacttgacagtgaaagttgtttgaagcatccctcccttctaccttccctgtcttgccttaaactttgtggctgccacatcctggatgaaagtatcaaccgcttgaggagaaggttgagggtaatcatatggtagagcaaaaacattctcagagtctctcttatctttcctccttcacctctcctgtgtattattcacacttccttccctgcttccaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgagctctcaaggggtcagaagaggggagtatgtgaagtggtttgcctgcctgtgtcaaaacctgatttctgaaaaatcagcatattttcattctacctgatatgggtatattctctatttggattctttcgatctggtaatcctgaaacagtgtgttaactacatcgcacacacaaaaatgtctttagaagggaaaaacaaagctctccttttctacttttctcttaaaatgtctaaaatgtgcctcacccttgagtcaggttcgtcccctggactaatactgaataaatgttttttcctatgtaacagccgcttgaacaactgagtccccatcctgatgaatacttgtgacctgatatttgtcctctttttcttttctctcattatgaaattatgctaattatagaagtgggataagaaaggaattaccttaaatccccacacccagatagccagttaacatttcgattgtatttaagttactggaatcttgttttatgtaatgtttcattctagaagcagggaaagaaattaaaaaagggaaaacttttttctgggctttgtaaaatagaactttaatgcacaagaacacaagtaaaggaaaactggataaaacattttttcacagaaagttttagtgtctattttttaacaataattctgagagagagagataaaatgaaagattgctgatggaagtataagttgatagaacctttttggggttgactgtatgcaccaggaagttttaaaatactcatttcctttaacttagattttaggctgcttatagtctagcctaataaagtaattgtttagtggtgatcctttagtagcatacatcttttgatatagattctaaatccctatggtaaatatgttagatttacctacctttctttagtgaatgtgttggaggcagagggagtattttaaaaggttgagaatattttcagaaacctcatcttgctctgcggttccgtgacttaaccctttttttgcttttctaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggtaagatttagatctttggggccttgtaattcattcatgaaagaattatcaaacacttaacatatatgaggcattgaagacgataaagcgaagaataaggcatgagtcctgcatttcatgagcccagtttctgataggctgaaatgcatataattacgtataaaatacagcattctgtgttagaatgataacagttttatctgggtttaggaaagtcatatgcatcactttggattcatgtgagaagggcttctgagaacaagcattaattgaattgagtcagaattgtgaggtggtagtttaaaaaaaaagtatttaaattactaacagagcttggtcatagaatattttttgctcttctgaggaaacctaactggcagccacatagtagagtagggtatgcaaattggatgtggtcaatattgaggtaatagacattagatgaaatcagattcctctctcttttccttgcctatttagtcagcagattatttgaggcaagagagtggtttgggcaagacctgatccaaccaacgtaggaactaggaggcaattgaccttggacaaatgacttcatttgtggctcattatctttaaaacctgaacttaatgaactgaaccctttacatacagcaaactcaggggataaatccaatataagagtcaaactgtgtaacagctgtcttgggggtttcctttatcatggaagtgataactcttactgtagcactttgtaaatagatacttgtgggaaaggtttcagagtactaaagagagaatcattcatggacccccatctaaaacaaatcacaagtaacagtcttgtattttcttttagtgttttttcctgttcatttaagcaattgggataagactgtatagaaagttttatattctttttgttaagtattatgactattttcccatttgctatatacattagtccatcttttgaatgttctctaatttatttaaataattacctatccttggacatttacttccagtgatttcctgttaaaagtaacactttggtgtagccccagtaagacgaaccattaactgtgtttaattattccattttccttgaaagattataaaatttctctgtaaatctaaagctttacaacttcaacatagactgcacaaccttggtgataaaccatttccatattaagcatatacattagtgccaggcactgggtactttatattaatatatataaaacctcaatcatcacaattattctgcaggtaaaaattatttcctctgacccatgaggaaaccaaagcctagaaaatttaacacatcttagattacacaactggtaaatggtaagaggtaaaatttgaactcaaccaattctattattatttacccttatgttcccctcccctatcccatgctaatctttgttactgagtagaaattggtatctggttgttgttgttttttccctttgatctatcaggagttgaagctaccttgtgcttgggtggttgaatcaagtggcatccttaatgtcctaatcaaactcttggaagtggttcagccctgcctccaggcagccaaggagcagaaggaagtccagaccccaaagtgagtaaccctatatctaccctagtttcgtttctatttccctgggacatgggcctgaatcaggcactcttctggggcatgtatggggcaaatttgtggtacttctgtagttttaaaattataaaggaagcatctgatgaaattaagatatattttcccaatttgtgcaggtttcttgctttcccaaaacagatcatttttcttttttaggtggatcacaccagtgttgctcctgattgatttctatgaaaagacagccatctcctcaaaaaggagagcccagatgactaaggtgtgtaatgtagtatgtatgactgcaggacggtttagcttcctgaggcaagagtagaccagaagagaatatgagagagtagtgaagaatatagaagtctctgaccaatgtataaatctcttaagggattttcatagctaggtttctcttctgaataatttactctggaagtaaattttgaaggagtgtgctatctccagaggaggagcggcttttctgttatgtaagggactgagtatacagcaatcctaccaaaaagcaaacactccttagatgaagattattgtgccacatcatctcactaccttcttggaaacagaatttttgtttcagtacatctcaggtgaacattccccttttagggaaaatcagtagaaacaaaaggaaagtagaaaatggcaagataaggggctgtagatagtttttttgtctaggaaaagtatcttagtccgttttgctgttgctataacgtaataccacggactaatttataaaccataggctgggcactgtaggctcacgtctgtaatcccagcactttgggaggctgagacaggtagattacttgagttcaggagttcaagaccagcttgggcaacacatggtgaaaccccatctctccaaaaaatacaaaaattaaccaggcatagtggtgtgtgcctatggtcccagctactcaggtggctgaggtggggagatcacttgagcctgggaggcagaggttgcagtgaaccgagccggcatcgcgtcactgcactccagcctaggtgacagagtcagaccctgtctccaaaaaaaatatttaatataaactgtacaagtttatttggctcatagttctagaggctgatctaagggaccacatctggtgacagccttagtgctgcatccttctattgcagaaggtggaagagcaagaggtgtccaaactcgcttttataaccaacccagtcacaataactaacccagtccgtggataatgacattaatccattcatgaggggcggagtccccatgacctaatattatcttttattaggccccacctcccagcactgttaaattagggattaagttttcaacacctgaactttagaagacatgtttttaagcgtgtagcagagagactaaggaatgtgagagtaaatgcatatgaaaaatgttcttttggtttttaaaatttattgtccagtatatttctttttcctgggtgagttttagcagtgaacactgatgaagttactatttcttctaatcaaccttgaaagaaatacaaagaaactttgtacttttatgtttagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggtacatgctcactcaccaagcttgtctaacccgtggaccacaggccacatatggctcaggatgtctttgaatgcagcccaacaccacacattgaggtttttttgtcgttgttctttttagcttatcaaatatcgttagtgtagtttatgtgtggcccaagacaattcttcttccagtgtggtccagggaagccaaaagattggacacccctactgtaaactttatcaaaaagaggggtatgtgttttggttttcttctttctgaaccagcattcctaacgtgttaggaggaggagagttaccattacctaattaagtatagatttcagaaaatcgagtcttcctaaggtcattgattagaccttgggtctgtagcaatttgatactatccctcttagaaatgattttaagtgtttagtcaagggctagggagtggttagggatggtatttgctctgttggaaggtctacagttcattataaggccttgtgtatgccacttgccttctggggactttcaggttttttctctgtaaatgataaaggtgggataaattgccagagttccttcctgttgtagcattttacctgggagatgtccctcccctcccccacctttataattcatttttggtagaggtttttttaatgtctgtttgaattcctaggttaatgaggaaacagggaaccgacgccctgtgatgctgactctcctcagggtacctcggctgaataaaaattcaaaaaacagcaatggacaggaactagagaagacgctggaagaaagcaaagaaatggatat

SEQ ID NO: 5687 - DNA, 102502 bp, human; identical to SEQ ID NO: 5686

SEQ ID NO: 5688 - DNA, 54667 bp, human
gaggctttcgactgagggctagcgaggggagcacggctggagcagggctggagcagggctggagcagggctggagcagggctgaagcagggccgcggaccccgcacgctcctgcgggccccgcggagccattgcggccgaggtgagcgtctatccctgggctggagggcgagctctgtacgcgcggccgttctcggtttctcgcgggtggcagtggcgaggttggggggggagttcccacgggaccctgcgcggaggcgcggaggtggcggccttggggagcctgcgggaaaggctgctggaggggcatggcggcctgccccaaccctccctgaaccccgcctcctctcccctcccccaggcctcggcaggcgccagcggagagctagccgcatcttcgggggcagcccggcagctgccggcggcgcggcgagagagcggctgacagaggggatgcgaggtaccggcattagccatggccaagtggccctaaagagagagtagaggccgggccttcagcgtttctcactggttcgaggaaggcggcctcagaggagagggaaggtgaggggcgggcaggcaggcttcgcgggtaactactaggcgttgcatatatatgttttgatatctaaatggtactacacacacacacacattcatttcgactaactgcttgtttaaaaatctgagaatatgtcttgtagatcttcttatatccgggaatccaaatttatgttgggttttaaacagctgcattgtatgattgtactacagtttatttaaccatttcccgattgatatacattagcttgtttctctgttgggggagggaggggactattacaagcaatgccataatgaatgggtttgtgtatatgtatcatgccatgtatgagtatttctgtaggagaaattcttagaagagtaaccgctgggtcagggtgtatatgcattttgaattttgatagatttgtccaaattgccttcccaaaagcctgtactaatttacactctttaatgttgtgcgagagtgcctatttttccacagttatgccaacacgtattatcaatctttgtaattttagccaatttaaagggcaaaaaaatcgtatgtcattgttttcatttgcatttccctgattactggcgaaattgatcatatttttgtttgtaaataggcaaatatcaatagtttatataggcagttttcctatctataagcaataagcattttgaaattttaataataaaaaacctgttcgcaatagcaagagaaacgaataaaaatacctagaagtaaactataaaactttattgacgaataccataaaagaacatctgcatgaaaagagaaggaatactatgcttctgaataagaaggctcaatattttagtgatgtccatttttcctatattggtttatacagttgatgcaatttcaataaatataccaagtttttttggaacttactatgattctaaagttcatccgggggaaaaaaatggctaagaataactgaaaaaaaatattttaaaacgtaagtaaagatagggatatttgtactactggctattaaaatgtactctaaaggaactatttaaattagaacggacagaacaatgcattagaatggaaaagcccacaaatcaagccagattggatcccaagatttattggagaaacactgttggctagacgtggaaaaactgccatattaaaagcttcaggcatttccccccatccccgaagcttgaatattcctttgagggcagactcctttgtttggagaaaaccactttattggatctttttggttatgccaaggtaaagcttcagtagttaaaattggtggctttggaactagaactaatgatatggcctttagttagattaagatggattcaggttagcctgcagtgcggcgagggaaggagtctggataatgtaggtttaaaaatttttttccctatctaatgggcaaaaaatgttatgtcattgttttcatttgcatttgtgtgcttactgtgagattgaacgtcttttaaatgttagtccaggataatatgttattcctggagacaggtaacaatgggggactctttgctccgcttccagaatggagtttggctaattggtacagccttgcccggaagcgtgagaataaacaggttgactttttaaattttcctcaagcactaggctctagacacctagatcgggggcggaggcagttttcaggacatggccgagatttggcgctgagctgtgtcatcgcgaggtttggcagccagctccgcagtgggtcggaaacctcgtggtaggcgagatccctgcaggacgggagggttcctcccttcccccgaaaaactcccagtcattttcatgaagctccgcctttctcctttttaggagtgtgcaccaggtctcgcgatatctcatgtttcctaaaggcgaggcgcgggcggcatcctgcggtgaattaagaaggtctcgccgaggctaaagcgtaatatcgcgatagttctcaacgcatgcgggagccggccgtggtaggttggctccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtagctcgcgggtggggggtgggggggcagtgactagggtcggtccgcctgctgttaagatggcggcggaggctgatgtctgtccggccaggacccagcacagaggtgttggctatctgcctttatgacgcctctgaggtgcccagcgttaaggaggtgacgattggcgaaacgccggggtgccggtaaactagacctgaggcgaagaccacctcgtttcttgtccgttgaggcgacaccatttcctgggcctcggccgcgtgtgggcccgcctttgccccaccgatcggtcaacgcctccgttgtcgccgccgcagtgggcggattgggaagggtgggaggggagtctggagttcgctggggagtggggttgggggttaaattgaacggtgggaaagaggagcaaccaatgaagagtggcccctttcccctaccttttctgccggccaacctccgttctcagcacctccgacgacccggatgaataccctggtttttctcgaggtggggtcatcttcgccaactctcgcggttttagagctaaggcttagggttcaagcagtagtgtcactggtgtactcctcctcctctccccacacccctcctaattctgtcgtcccatctaatcttcatctacgtggatagttgaggctggtatttaagggaggggggagtcaaagcttttccctgtgactccttccccagttctaaattcgagtttagcctaagtcctctagcccgctctgtctcccccttccattggtccccttggcgcaggcgttgaatagagcttatcctgttgcctgcatttactccatctttgtggatggtgccatagtagccttccatttccttaagtcttcatgtttgtatgactctgatccggatttcttagctctgcatgctgctaaaccactattaagcgaaactatgaacgggtcggtgtttggatattgcagtttaagtggccttttcgtttacggccattagccttgccttcctcattcctccccctcagaaggctgtagaggataactctccagtaaacccgctttctgtcttccctgcctcttccatttcccctgcaagcctgggaaccgccccttttccctgccttgctctgagtttctggagcctcttggtctgtggacatctatttttgctgctgagcacctcttacctgcttctcacttcttaatctttctatcccccactccccatactccttttccaggagctgaatcccttagaaggaagataaccctcctctcaggctccactacattttaccccttccatttactagaaaacagcattgattgtcctgccccccagtctgccctgttctttatttcctcttccccccatgccaccgttactataggcagttaattccctatcatttgtttctcctttgtagattacatgttcagcattgttttcttttagccccagtgttgcatagattgaggagataccaacattccccagtcataggcggcggtctggtatggtgaaattaatagtgtgtgttttgggtgtgttttgggttcacattgaaccttgtgaccttgggcaaattttcagattctcagttcatctatataatgggaatagttgtgcttacattagaggattgttgctagaattagttaaaataaaataaaataaaatgtttagctcatggtaggcacataataaattaggattactttttggtgtaagaatgcattggtagatgtacctgtgtcatatgctaattttatgacctgggaaagagtaagagatttttgtttctttaactgtacattcttggtgtatttctaggccagatctataacgtttatattttttttcctcataggccaaactttttatctccagtggttcatgatgtttgaacgtgattcccactctttgtttccttctaatggtctaggaatttcagtgcgtaatcactatcctggaatgaccaccagccataatgttcctgtcaagaaccacacccaagtgttctaccttttggaaggggtgcctcatgccctgcctactcatttcttccactccttcaaaggcagtctgtcctgtcattcactctacaaaagtaatttggtgtcatgcatttcacagtggtaaaaggaacttctgttagctagttttgaagtattcatgctacttttcacctccctcatttgtttggttcctcagatcagtgtggggatctgctatttggcatcttcttacctgagcaagataattcctgtccgagagagaaagatcatttggaatacccagcttcttttccatagcaaattactgctggctctttaatacactacttcctgttgtgttattgccattttatattttctaacgtacttattaaacagatgtgactatttgacttggagaaagttttccttacttttttttttttttttttaagatggagtcttgctctcgccaggctggagtgcagtggcgcgatctcggctcactgcaacctccgcctcctgggttcaagcgatttacctgcctcagcctcccgagtagctgggactacaggcgcgcgccaccatgcccagctaatttttgtatttttagtaaagacggagtttcaccacgttggccaggatggtctcgatctcctgacctcgtgatccgcccgcctcggcctcccaaagtgctgagattacaggcttccttactgttaatatattgattagaccaatattaaagtgtagcattttacaattttttttttaactaattctagcaacaaccctttaatacaagcacaactatccccattattttacttcggctgggtgatgggaattgaagtagaaacgtggtgaaaagtttactaggatttaaaatttacaggaggtaaccatcccacaattagctgtatgtggactctagtttcgaacttcagggtctgctttatttaatttgaagtgctttgtaggtaataaaattttcttccattttcattggagggcaggaaatcactttctgttttgagattttgcattggtgcattttaccgtgggttaagcagtgatcacaaatttattaaacctcaatttcaatttgacccttattgagcaatagaataaatctgggaatgataatctaggtgtgacctaaaagtttaacttattctaggtagatctctgagaagagaggaaggagtgacaataccaaataaaaactttgtctaaggttcaatggcaaagttcaacctgagttgccaggatgtttatcgtttgtctcccaatatggccaaaaagcatgtatgaaggtgaagaataatttttatatgtacagttgttgttttttttcacagaaacaatgaaacaaatacgtccttagtgtttatattgagggtataaacttgtctaaaaaataaactgtcttctataatttcatttgggttgagaactcagttttcaggaatgttgtctaagcgttagaagtattagagttgttggttctgaattcctcagttacttctcaaagcaggtcctaaaaaatgcaaatagatatgtaaggactattgctttagaaataataactagttatgtttgaacataatagaatggttaaccctcctcacacaccctaataaatgtgttgtgtatctcactcctctcccccaactttttttttgtaggtcctccagcagcctgacctgagtgggttagtgatccagagaaaccagcaggccaacttggtcaggaaggttcgggaagctgttggagcagtgtggggaatttcccaccaggatgagtatgattggctgtgattttaggttagtttttgtaaatcttgtgggaagtatttgtattttacttcctggaatggagatagtaggggtggatgtattcccattctgtaatggagctactttggtttcttccattctctggatctgatgtggtactggttgcttctttttttaaagtggagctcattactgaattaaagggaattgtttaaatgaatgatgtctgtacatgattttttaaatcaccctaggcatcgttcaaaaaataaaattgcaagtcattatgtctaaccagttcttattaaagttacgaaaaatttcaaacatgcaaacattgaatagtataataatccccccacttacccatcaccagctttaatagtatcaacttgcacattctatttcatctatacttctgtttgtttggttttttttaatttttttaaattgagatggggtttcatcgtgttgcctagactggtcacaaactcctgggctcaagccatcctcccttcttggcctcccaaagtgttgggattacaggcgtgagccaccaggcccagcctgtttcatctatacttctaaccactgcccccctcaatggattatattggaataaatccctgtcatatttatttgtaaaatacttgtttgtatttctaaaaggcaagggctctttaaatataagatcaaaactattatcacaactgaaaaaattaacagatatttaaaaatatcaaatataaaatgttcagatttctgatttttttttaagctttgttttttttcttttacagtttgtttgaatcaggatcctgagaaagcacatttattgcaaagcattgatacagctgttaaatctattttaatctgcaggttctgtcttttgttttttttttcttccaatttatttgttgaagaaattgtcctatatatagtttcccgccccccatatttggggattacagcccagtagtggtgtctaacccattcttgctcaattaaagaccctggaggacccattataatggaacaatggctataatctcctgtatcctagttggagttgatagtgctgtcataggcactatcctaaaataactagtcatggattcctttttctgtggcaaagtctgatttgatacctgacttcagttccatgtcttggccttgctcattgctccacatgaaaagtaggcctcctggtggaagaagctagtgtttcctaatgacctgattgtgcctttggggtttttcatgcatggtttcaatttccttaggtgatttagttatttttatactactttataatgttgctttttattcttttgatgttagtgtctcagctgttctgacccataacttctaagctattaagacctaataatgagttcctggctgtcatacagttcttgaaatggcaatactaaaacagtttttgagagcttctacttacatgttgattttcagctattatacacaaccttagttttcctactgtgatttttcatttcatttcatctgaaatttatgtttccttagcataaagtcctttaaggacttttaggctgctttatgatgatctcactatctataaggttgatattcataagtacttgggcttttggtgttttgctgtattattcgttgtttcctcaacgactggttactagatgtttatatatgttaatgtcaggaataactcaacttttaagtcgtttgatgtttcataggtggtgttgttaaaacttgatgtacttgttgaccagcttggtcttctggatatagaaatcctttcaggtagtgaagaagtggctctatgagtaaaacaactgtaggttttgtttgggctgttaacctgagcattttcaacttttaagttctctttaaaagtttttagtcatttggctttaaaaattacagttggtggcatagaatgatcccataatgtgattttacagaaagttggaatgttttaatttattatgaatgtaccattacgtggagattgggattgtagatctgattcagtctggattgctgattgaactagatgaatgttaaaattcttcaactctgagattctgatggtataatcttaggtattgaaagacagcagtttttcctttcagtagtcattaagtaaatggtgactaaaagtagggagatgaattattctggaatgacctttcactataaccatttagatttaaaagattgatgagtctgaggatactgtcatgaatttatgtaccacctttagcacaatccaggttttaggtccttgtgattagatatcagagataattgccccagaagtgcgtgggtatattacatttggtggctgttaatgttttggaatgattttggaagattactttgggtacattatttgctatgattattttcttatattcctgtctattttatagtgaggcatgtttctcctggtctttgctttttttttttttttttttaaacttccaatattctttattacggcattctgacaattgagttcttacaggtggaaagacctttcagcacagcgattaagaacatggactctggagctagattcacagagttcaagttctgactcccatttcttaccaggtgtgtcatgttgtgcaaattacttaactgctttgtgccacacggtccttcatctgtaaaatgatgataatactgcctgccttatagagttctgaagaaatttagctgagttaatgcatataaagtgcttagaacaatggttctgaaactttagggaacatcagaatcacctagaggacttcctaaaagattggctggtccccactcccagagtttctgattctgtagatctaggaggggccccagattttgcatttctgataagttcccaggtgatacttctctatttcctgcaaattggcagctggatccagagacttgataaatttcaggttcgttccctttggcaaatatattgcgggggggtggggtgggggggtgttcattcacaacattgattatgttacgatgacttgaattttttggatccattaatttgttggggggctacaaaatggtgacgttctgatgctatcattttgttttcatctgttagctggaataattttgtttcccctcatcttttatttggttactcagcaatatagtttatataggaagagcaggataaatactcaattttttaaaacattgctttcaagatgatgaattggtcccctgtcatcttcaaaaggttacacatataagtgtatatataactatgcatccatagatgtaaacatttgatgggtttcaatacattgcagttctgatccttagcgaagttcaaattgcccttcttgtggctagtggaactctcttaaagttggctcctgattcttactgacatgctctctagtagtctttgatagcttccttgctatctggtatgtcaagatgtttccaggcgcattcttgtgcatttctgccccagacctggaattagctaatgggattaagataaaaggtgaagtcaaaagaaattctgtttttgccaagggtagcttggaactttctatcaagttccacttttctctttccacttaacctccctagcctgcctcttcattcttctctacctttttattagagttaaggtggaaaggtttgagaagccttgataatcataggaagatcatggagcccaggcagttccggatttggggcctggccacttactaggtctgtcagtttgggcaagttaacctatatcagttatgatgtggggaaataccttattcatatggttattggaattaaagagaaaatgtaaggtgttagtacatggtaggtgatcagtagatggtaatttatttaatgtactattttacttaactccttcaacagctcagaggtgggcagtcagggtggtgaaaataatggccatttaacaaaatgtgtctggaccctttaggtctgtgtgggatcatcagtggtgaggcaggatagggtttgttcttgagttattttgggtctgagactttggccagtgataactgaatgttccatagagtagtttttcactttggaactccttaggagtcacatttataccctctgaagggtcttagctagttctgtaatgtgtattacattggttaccttgatctctctccgtctatactggcccctcctattcaaggtgttcaaggttctgttgtaaccttagtaacctataataagtattcctaatagtcatcagtatcaccactgttaacacatttgggcagcaccatgcatggcaggtcagcaaacaggtaaatcttatttttttaaacattacacataatatctaaagtatagtatgtggcatgtaataagtgctgctgaataaatggaagtcattgttcagtttttagcttaatatatctttttttttcttttaacataacatttactgaatgttgctaagtataaggagtaagggacataaaatgaatgagacttggtctctgcccttgagaaactcacagtcgagttaaggactgtgaaatcatgtttaaagttccttagccttttcctttgtgtcatcatttcttcccctgcactgtctatgcatgatatagcctgtccattgtttctcacagctttcctaattctgtgtgcctccccagcctttgagactgctgatatgtgagaaagccaacaattgtcttctattaatacagggtaatatcaagaaaaacctttgggccaatattggatttcagagtggcatgtgcagttgacattacaataccagtttatggtctttagatgggcctgtacacctgggctccagcctctttcctgtgcctttaaactgccttacttccatctttcctcccctataccctacccttaatgtacttggtacataaaaatagaggctcccatacccaggtagtgatcaagtacaatgtaaagaaacagctgtacttcatataaactaggattcgagtgggcctagggtatatcactaaatttccattcttatctataaaacagtaatcggaaagcctatttcataggttgctgtgagcattaaagcgagatgatgtatttttaaatgcttgtaaagtacgaagataaggtcattataatttatataaaatacttagtagctatgttacttggggcaaattacctcatcactgagccagtttcctcatcctttaaatgaagatggtgatattcatttaacaaatatttattgaggacgtagtcattgcagctacatcctgggaatacaaagataagtgactggagaatgtaggacagtgtggtctaggggaaggagacttgcaaatcacacaaaagggtcagtatggtaatatgaggaatgaacaaaatgtgctatagcagtttacaagaaggcatcagagaatgtcacagagttttgttagggttaagcaagataaatgaaaagtacttcatgaattcaaaaatgctatacaaataagttagttaaacgtaccccaaatgaatcaatagtctcaaaccattattgtttcatttcttcacaagacttactctttagatgcatttatttctttgagctagattttatgacctccttaagggtaacctgtagtagagtatcctgaaagttaatgcttttgtctaaaaggatttttttcatccattttatcattttctagtttttaatcactgaattcaggaaaaactagaaaatgtgtgcatatttggggagaggatatacataattccaccacaatgtttagtcactgttaacattttggtgtattcacatcttaatgataagggtagtgtttaaggaataagaaaagaaatctagtaggaaattttaaggataggcatttcccagaataggaaactaaaaacgtccactaacaagaaatggtactcaaactaataatcagaaatgcaaatttaaataaggtcatttttagtcattagattgataaaaaataatttgataatatcaagtcatcgtaaaaggtataaggaagagtctggccttataatactgcctacaagtggcgtaaattgatacagctattttggaggcaattttggcaagttgcaagagagtacatactatgtgatgctatttatgttttaaaaaaaaccatggcaaactgacaactttatttgggaggagggatcatggggaactttacctttttctgtaatatgtgcatttctacttctgaaaaatatactgagaagtacagagaataatacaacaatccctgtccctacccccactccagaattgatcatttttaacatttatttttgccttacatttttttgtggagttggaagtaacacaagttgagtgtccctaatccaaaattcaaaatgccccaaaatgagtttcaacacgatgccacaagtggaaaattctacgcctaagtacttaacactttgtttcatgagcagaattattaaaaatattgtatagggtacaacgaacattatttgggtgatggttacactaaatgtctagacttcactactgcacaatatacccatgtaacagaactgtacttgtgccacctaaatttatacgagaaattgtgtaaaattaccttcaggctgtatgtataaggtgtgtatggaacatgaatggatttcatgtttaaacttgagccgcatcctcaagatgtctcatgatgtataggcagatattcaagaatctgaaatctgaaatcctgctggtcccaagcactggataggagatacttaacctgtataggtaaacaggagatacttttttaatacccagcattcccttccccccttacaatcagtacaatgaattgcttgaatttttctactgtgagaatggtataaattatgaatgtaagtaaaagttcaaaaccgatgtggtggccacacaaaaacctattattaaataatattaaatttgtacagtattttagagtttgtaagaagcattctgattttagtaagaatgctttgggaatagaactttttttcgtttgctcattttcttgttaactcttgtttgaaaacgttttcctgaatttgtttttaagtaatcttcatgactgtagaattatacatggcttattgttgaaaaatacagataaacagacaaatttccgcaaaccccaaactcacagataaaatactcttaacattttggtatgcagtatcttcttcgaaggcttttcttaactgctctgtagccatattatatattttttcagaaatgctctttttaaaatgtaattcattacctcccttccagctttcaattttgtatgaaaaatttcaaacaaaaatgctgaaaacatagcacaatgaacatctgtataccatcagctggatccaacaattaagtatttgccatattagatttatatgtacagatgtgtgtttaatttttctcaacattagaagtaaggatgacactttatccttaaatctttcagctgcatgtcttaagaatgaggacatctcagccgggcgcagtggctcacacctgtaatctgagcactttgggaggccaaggtgggtggatcatttgaggtcaggagttcgagaccagcctggccaacatggtgaaaccctgcctctactaaaaataaaaaaattagctgggtgtggtggcacctgtagtcccagctactcgggaggctgaggcaggagaatcacttgaacccaggaggcggaggttgcagtgagctgagatcacgccactgcattccagcctgggcgacagagtgagactctgtctcaaaaaaaaaaaaaaaagtaaggacatctacaaaaccacaataccattatcacgcctagggagtttattttttcttaatattatctaatatccggttcatattcacattttctcagttgtccccaaactgtctttttttccaagctgttttctccaaactagtgtagaaatggtatttttaactttgctcttcccacatattgacccctgtttcatgtctttgtcattatgtatacttctgtagcatttttaatggctacattgtattctattgtatgcagaatttatttaaccagtttgctttgttcacaccttttgctgtgttcatacttttccctcaggtgtccccaaactgtcttttttcaagctgttttctccaaactagtatagaaatggtattgttaaatttgctcttcccacgtattgacccgttccatgtctctgtcattatgtatacttctgtagctttttttttttttttttttttttttgagacggagtctcgctgtcgcccaggtcggagtgcagtggcgcgatctcggctcactgcaggctccgccccccggggttcacgccattctcctgcctcagccttttgagtagctgggactacaggtgcctgccacctcgcccggctaatttttttttgtatttttagtagagacggggtttcaccgtgttagccaggatggtctcgatctcctgacctcgtgatccgcccgcctcggcctcccaaagtactgggattacaggcgtgagccactgtgcccagcttctgtagcatttttaatggctacattgtattttattgtatgcagaatttatttaaccagtttgctgtgttcacacttttccagtcccagtttctcatgattttaagtaatgcctcctaacatacaggtaattcagcattcagtaaataagtgtcgaatgaaagaagcataggtacatcctaatagataaatatttatgagatccatatttaatatttttaattttttatttccataggtttttggggaacaggtgatatttggttacatgagtaagttccttagtggtgatttgtgagattttggtgcacccatcactggagcagtatacactgaacccaatttatagtcttttatccctcacccctttcccatcctttccccctgagtccccaaagtccattgcgtgacatccatatttatatccttaagaaatttctacaaccggaatgtaaaaatgtaaggcttttaatactcattgctaaattggcctttagaaaggctaaccttgcatttttcactgtgatatgtttagtatatgatccatcatgatttacaatattgtagcacatcaggataagccttgataaatcagaagagtataaatctggatatagccagtatcgttgtagatggctcactgcatatatacacgtatatacatatacgtacgtacacgtatatacatagacatatacatatctgctgccatatttttccaggggctagtttgactcttctactttggagggctttgcagtttgttaacccaatctggagtccaggccccggcttcttacatttctttaaatatcttggtgagaccagccttaaaaggaagtatagtctggagagatgcagacatcactagaagatatccttttacgtagagaattttagatttttgcttttaaaaagtaaagacaggctgcttttatgggtgaattcagatctctccctctagcaaattaccaacagctttaaaagggtagtcttcatgtccaacagaaaagctggatgataccctatatttcctattatccatatcaaactccttattttataggcccagttgtaggagtaataacatatccatggtaacatggctggatagtggtgaaattgagcatcaaacccaggttacctagtccagtattgttttcactatgttttatctctccttaaaactgaactttatttctaaatgtgccatctggtgtcatctgtagaaatacaaagtaagtggtcctcttcctatgagaaagttactccccaaataggggaattttaaagtagaaagtcaacgtgagaaaggcaaaaatccaaagaaagctcagtttctttgcccttttaaccgtagttactactttctgacatgagatcaacttggagctctttcatggaacagttcgatttggccatgtgttttcatgcatttatggatgctataaatcagtagatgagactgaatttcctgcttgtaaaactttttcaaattaaagggctgctttctaagtccatcttattttcccttccttttttcaactgttttaaactataacatgtttgctatttttaaaaagattgaaacaaaataatagtttacaccttttagcattatagttaagtattactgtgttaagtatatacttatgttaagtatttttatactatgttaagctttttatgctgaagtaatggtgtgaagtaggtgtgtacttttattttcatccaaatggttagccagtagctcctgtttttcttcctggcaaagtctatttgatctttaaaaatattcttagcttaaaagtgaattatttgcagaagtgtagttttattttttaaaaacctaggaatttgtggcaagtagaaaactagcatggttacttttagctgtttagtttttgaaaataattcagattgttcatgtttaatatttaacatttgtcttagactgaaggcaaagtactacagatagtgctttaagggatcttagttattgtacttccattttacatcatgttggaagcccagaatgtcataaggtcttaaagccagttggtggctgagaactagagtacctttgcatacttcactttcatttctagcaagcatctttcatgtaatagatatgttttaaagcagtagattgttcagaattgtctggtttatttaagaacatttgaaataactatgtgtcaggctgtgtggagcaccataaaatttactcagacagccatttttttctatatgttgggacacctttgtttttaaaggctttgttttacaactttcttatcagtgaactaatttgagcctcataacaaacctgtgaagttggaattcttttcaacatcctggaaagagtttgctgccaggttgataattgctataaataacttgctcttttaaaccatgcaaaagaatctttgtctccattccttccaaattcatttgaaccagctcaaaacagttgagacccagttaaaatttttgattaagtggcatggcctgcacattatttagtagactgtttaccttttgcagaactgtataatttgagaatgaaactggagcctcccaatctcattgtcatcaaagtagagtttaagttgttggttgtctgcagttatggctaacagtatggagattagtatatactgtatgttctccttcatatgcaggtaatgtgtagaaagattgagaaggccagctcttttgcatatgatcagatttatatatctgtatttctgtcttatcaatctgtagaatacctagcataaggtttctgcctttagattaatctggagccaaaagaaatagaacaaatagcaatacggcttactctttgctgggcacaatcctatgagatagacttgtttattttacagaggtgactggactcagagatgtatggcaacttgtctaagatcacacacctagtaaatggaatttaggcccagatctgtctgtttcccaggcttttccattatgctgttgtcctttacttcatttttacttttcttccagtggtagtcttcagcctctacttttttttttttttttttgagatggagtcttactttgtcactcaggctggagggcagtggcatgatctcgactcactgcaacctccacctcccgagttcaagcgattcttctgcctcggcctcccgagtagctgggactacaggtgtgtgccaccacgcccagctaatttttgtatttttagtagagacggggtttcaccatgttggccaggctggtcttgaactcctgatgtcatgatccacccacctcagcctcccaaagtgctaggattataggggtgagccaccgcgcccggccggggaggtttgatctttagagatgctgcttgtttctctgcaaacccaaggacatgagagaattggagctgaataatgcaaaaggggtggaattctgtttctttggtatctggtaccatctttattgtatttgacagtagtctatcatgtggctttgggaaaaaaataccatatacctgtgtttcataaatgaaagggaaatacaagggaaaacattgtcatggctagatagacagtgtcttaactttctttagggcattggttcctaatgttcttcaggtcatagatccttttaagaagccaatgaaagctgttgaccgtcttctgggaaaaagaccaacatatgtaaaatttcccacagaatttcagggtttttgtagtggtcatccttcagtataggatgaggaattctaaagattcctctacacttgtttttctctatatgtcattaagatgtctaaattgctatgttgtttgttcttgtatttcttagtacaggcgtccccgacttaatgatggttcaacttaggattttttgactttacgatggtgtgaaagcgaaacacatttagtagaaagcatacttgagtacccacataaccattttgttttccactttcagtcgatattaagttacatgagacattgaacatttattataaaacgggctttgtgttagatgattttgcccaactataggctctaatgtaaatattgcaagcatgtttaaggtaggctaggctatgatgtttggtcggttgggtacagtaagtgcatttttgacttagatatttccagtttacaatgggtttactgggatataatcccatcatatgttgaagagcaactgtatatatttttctagacttatttttctacacagtggtcaagggtaagcttggctaactgtgtcacttttgcttaaagatatactctgtattatgcaaatttaatttatcttctgtattgatcttataattggttgtgttttcagcctttgggcatgaggaagttgtaattctctttttttgtgtattgacttcgttgcctttatattacgattgcttctaatctattttatttctgatttttttccttattttctacatttctgtacacctggctatctgagtattcatctcaatgccctgcatatagtatgtttataattgttgaatggaaagatgaaggttaaatgaatctaaattgtttttttcagttcaccaagagtttaatgtgacttggattttttttagttttgttaagcatttactggatagttattcatttattaatctgctattaataaatgacagttcatatgctggtacaggaatgcaaagataaatatgatacagtcccactcttgcagaactcagcaagcatagtggggagactgtcaggtaagtaaagaggtgtgctgattgaggatcaatatgcaggatatagttggggctaaataaagcatgtggggagctgagggaaatattatgtaatatcatagcactggtaagagaggtaagcagggaccaggtcctagaggtcttggatgctggtttaaataaggagtttgtacttgatgtaggtaggttttgagttttagggagattgctctggcaacaatgtggaggatagaatggatggatccagcaggaaaaagtctcactttaaaataacttcaatttatgagacttttcaaaacatatacaaaaatagaaaaaagcataatgaacacccatgtaactgtcacccagcttgaacagtgatcaacacagggctattgttctatttataccccgctcctcccctctatttttattaaagcaagttcctaagtcacagaatggcaaagcatatattgaataataatctaatgccatggctctcaaggctggcctgtgctgccaaatcacctgtacagcttgaaaaaaataatccccacttcagacctactgaattagatagctttgaaatgcctgtgtggtcaggcatttttagttttcaaaataagtctcgggtgaagtaagttatttttaagataattttaaaataacttctgacaaatgaaaatactttcctgaactcattgaatgctgcctgtggcccttctgggtgaaattcacctattcgatacaggcaggcttttcttataaatttttatttattttttgtagagacggaggtctcactctgtggcccaggctggtctcgggaaaactcctggcctcaagtgatcctcccacctcaggcttatcctcccacctcaggcttccaaagtgctgggattacaggcatgcagccagaaactgacaattcttaaggtgtagactaggaatattccagagtaccaatttaaaatgtgtagacaaggagtctgttcctctcctgcttaatttgcttaacttacacttaggcattgctgtttttattttttgttgagaataccaagaagggctccttagcatgctgtcatttcctctgtattggtaaaattgataatctgcaactttggtgagccatgtttggttgcctagttcttctgatgccagtttctctaagtaattgggagtatccgggaaggataactcccagatctgcagcttccccagactgtttgaatagaggatgtggcaggagatgtgttctcagatactattctcacgttcaaagtcaacattggaggtttcagattcctctttcttagtatccctccctgcccatattttccttgcttaagcataactgcagtgcagagaaacacccagagccagcataaactcttaatctgaggtatagtgtgttttcagattttaaatgagagactccttcaaggtatttctgcaaataatttccagatttgtcttgggtgagtaaaggctatttttcagttgctttattatgacactttactgtcagtgcccagtaaaacctaggtcagcagttctcagggcacttgagagtcatgttttatgtggctaaggatagggagactggtgtctgtaggagaggggcgtagcaaggtgggctgtgcatatagacattatgtgcaatgtagagttgtggaacagatttgggtttgaatccacgttttaccacttaataggtatgtggccactctcagtaaactgggcacagtcttcatctccaaggattaaagataatgcacaataggtatagagtaagtgttagctatttttttatgatcataaatgtttttcacaatatttgttgagtggatattaatgtattaatagataatcagaaactagataggatggaaaggcctgacaattatgtggtgtcccctttaacaaatcataatcagtgacacctattcctctataatcaaatagtgaatagcaggctggatttcaagatgcatcttactgcttgttgacatgaagaatgctcagggcagctctcacctgaatttactttcagagactataaggcaaaaggaaatcgttgcaaggcaaaaaataaagtattttgctttgtggtactttggagtttagttttctctaagcattttttgtttaagaactgccgtaatgcttccatgatttctatggggattttaggctcattttgattcatccccactcccgtacttacgtgcaacatctcttacctgctaataatcaaccaaagtgcctcctgtgtgccaagctccaaacaccagaagatgtagggaagaagctcctagagtaggcagcagctaatctaaggcatttgtttagatggtgttcttaatctggtgcatgtcctttggctcaggggccagtgttttcttccttaaggaaaattttaggcctggcacagtggctaacgcctgtaatctcagcactttgggaggctgaggccaggaggattgttttaactcaggacttcgagaccaccctggacaacatggcgaaaaccctgtctgtacaagaaatataaaaattagccaggcgtggtagagtgtgcctgtggtcccagctactctggaggctgaggtgagaggattgcttgagcctgggaggttgaggctgcagtgagccaagatcatgccgctgcactccagcctaggtgacagaatgagaccctgtttctttaaaaaaacaaattacaaaaggaaatctgattataaatggatccatgatttataggaaatttggaaggattagaaaagcatgaagcataaataaaactatgtgttaccctgccagctagaggcaaccattaaaggccaactactaataatgtgtatttcttcccttcccaggtttttttttttttttaactttcccaccctgtggcagacattttctcataaatagggaagtgataggtacagagtacaatgtaatcacatatggtgggatatccagtcaagatttgaggggttcgggagaagattgtccaaattctggatatcattctgttcaaacctgcataagtgcttattatattacagtgaaatagaggctaaatggtcccctacccccaattttcaaagggattcttacagttactccgtcttttcaagacagtttgcagccacttgagaacataagctagtgtctttatttaccttttcctctacatttcagtgaccccataattctctgcttccatttacagcctatatatatattttttcccccgagatggagtttcactcttgttgcccagactggagtgcaatggtgcaatctcggctcactgcaacctccgcctcccgggtttaagcgattctcctgcctcagcctccgaagtagctgggattacagacatgcgccaccacacccggctaatttttttgtatttagtagagacggggtttcaccatgttggtcaggctggtctcaaactcctgaccttgggtgatccacccgcctcggcctcccagagtgctgggattacaggcgtgagctactgcccctggcccaacattttcagaagaggtttttacacataccatttatgctttctcactttccattgattccctgactctagtctggcttccattccctccatcccactgaaacaattgcttgtcaaattgtctctattaccaatttcagtggacatacctcattttgacatttgatgcagttgatcactcttgccatctttcgtctctcgtgatagcataattagctagttttgctctttcctcactagcctctccattgctgggttttccttctttccttacctttacacttttattgtattgtattttttttggtagagatggggtttcaccatgttgcccaggctggtctcgtttaaggaatctgccctcagcctcccaaagtgctaagattataggcttgagccattgtacccggccccttctttgccttacctttaaatgctagagcaaataactcagttgcgggcctcctcctttccttctttgtaagcagtcatctccagacccatggcttcaagtaatatatgtgtgctgacaatcacagattttattcttaatgcatacgtctttcctgaactccattctacaaatatttgcatacctatcatgtggaagataccgtgctaggtactgagagcttaacatcttagaaaatcaaaccagtaattacagttgatacttgttatgaaggaaattggaaataaactgggtgctataatagaaaaattacagtgggaccaacttgaggtgggttgtcatggaaagcctctctgggtcttagtttaaatgtcagttcctcaaatggaactagttgtgggaaaggaggggtggcaaaaacattccagcggcgaacttagaaattagagtgttccaagaactaaatggaaagaataattacacagttgaggaaacaagcatagagaggtggatttgtctgcggttatgcagtgagtaagtgatatagcagggattctagcccaggttttctgagtctgtattctgatctagtgcttctcaaactttgttatatggatcacctaaggatcttgttaaaatgcgggttctgactcctcatatctaggtggggcctgaaattctgcaacttttaataactcccaggtgatgtcagtgctgctgatccttggaccacacttgattagtaaggctagtctttcactacatccaactgctcttgagccagatttgggaactacaggtgtcctgtgcccttaaactgattcagtattgaaagtcattatttttaaatattatcaactggaggtgattactatagaatatgagtcacgctttgagtggcttccctcaggatattttagttgtgtacacttgttctgcaggtaaactgtacaaaaccaagattcaaacctcaggggtgtaaggaaaggttgggggaataaggaagtgaaaaaaaatattagataaaagtattgaagtaatggtaatagatatggatggtgattcatagtaattcacttgttttcttttaagttggctatctttctaacctaagtttaggaagcaatgtttattatatatagagattgcttggtgccctgagttctggttctgacccaacaaaggcagtaggccatttctaggaatttgtttcaaactaacttatttttatggaaggatttttttttaaatgtaatagggttttcacctgattaacttctaagaggtagaactcattccccagttactgttcctttcattagtgaaattacagcatctcagcttctcatcttgggccctagtttcctctcttggagtaattttttcaaacaaataggattcagcagtctagaagaatctgtcacaaatttttattcttatctgccaatattttgtagtaataaaactggttttaaaaaaaggtgaggctgggtgccgtggctcacgcctgtaatcccagcactttgggaagccgaggcgggcggatcacaacgtcaggagatcgagaccatcctggctaacacagtgaaactctgtctctactaaaaatacaaaaaattagctgggtgtggtggcgggcgcctgtagtcccagctactcgggaggctgaggcaggagaatggcgtgaacccgggaggcggagcttgcagtgagccgagattgcgccactgcactccagcctgggcgacagagcaagactccatctcaaaaaaaaaaaaaaaaaagtgaatcgcatgttattaaagcatggacttggtagtcagacctggatttagatcttggtgctaacatttactgaccaagaaaggtactttttttctctcttacttcagttttctatctgtaaatagaggcaaaacttgacttgagtggtgaggactgtatgaaaaaatatcatatgaattccctaggtagcatgtctcaaactgtattctttggaatacttcaattggactttgagtagatgccacttgagaaaatggttctgtgcgctaataagcctcctttacctaagatgtcttagagccattaataatgtcaattagctatgtgactgccctagtggaagagaaattctgtctataacatttcccaaattacaggattcttgtctccctttatagagcaagacattctaacacactttggggaactccagtctcagtattgtctggcttgtaatggacactcagtatactaacgttcccccctcccactgttgaaaccagttttagaaatatgagaacacaacaacttctaaatttttaaagttgatgtctcatggacagtgatgtcttggttttttaaactacaaatgtttcttgcagtagaattatagacaccaaggtaggactgcacttgttatgggaacatttgtgtgtgtgcattcatattggctctgttattttattgggtgcatcaaatgcttacacttgggacttagagtctagcgccactcatgcaaataacctgagatgatttagaattatgccaccagcatagtttctaggcatccagagtcttgtgttggcagcagaagtaccccaagctaagctgtttccgtggggggtctggctgtagttccaggctccctagcttccttggttcctcttagttttctgcacgtggagctctagccttctgtcagttctgtgagctatcagatactctccagtaaattacttggctgcattaattatccagtctttctgtagttacagacacttgactagtatagtacactaggtcaaaacagcattagagcaagttgcttatttgtttgaagattcatcagtgactcatctgcattaaaaaagtaaaatggttgtgatttgcttatttcagtgcataagttactctgtgctcttgttttggaggattgtttttttaaaatagactttatttttagagtagttttacattcccagcaaaatcgagcagaaggtacagaaatttcccatatactgcctgcctccacacaggcatagcctcccttgttatcaacatctcccactagagtggtacacttgttacaattgattaatctacattgatacatcattatcactcaaaggccatagttaacattagggtttactcatggtgtatacttttggggtttagacacataataacatgtgtccaccattgtagtatcatacagagtagtttcactggccaaaaaatcctctgcgctccacctcttcattcttccctccccactaaccctcctcaaccactgatctttttactgtctctatagttttttcttttctagaatgtcatgtggttggaatcatacagtatgtagcctttttgtactgatttctttcacttactaatatgcatttaggtttcctccatgtttgttcatggcttgatagctcgtttctttttagtactgaataatactccattgtctggatgtaccacagtttatccattcacctaccaaaggacattgtggtttcttccaagttttgacaatagtgaatgaaggtactataaacatccatgtgcaggtttttgtgtggacataagttttcaactcctttgggtaaataccagggagtattgattgctgggtcatgtggtaagagtagttttgtaagaaattgctgaactgacttccaaagtggctgtactattttgcattcccaccagcaatgaatgaatgttccacttgctccacatcctcacaagcatttggtgttgtcagtgttctgggttttggccgtagtgatatatcatcatggttttaatttgcatttccatgatgccgtatgatgtggagtatcttttcatatgtttatttgccatctgtctgtctgtggtgaggtgtatgttaaggtctttggcccattggcccatttttaaatcagcttgttttcttactgttgagttttaagagttctttgtgtatcttgggtaacagtcctttgtatgtcttttgcaaatattttctgtcagtctggcttgtccacttattcttttgacagtgtcttttacagagcagaatattttacatttaggtctgtgatccattttgacttaatttttgtgaaacatgtaatttcggtttagattttttttttcgcatgtatgtatcgagttgttccagcaccatttgttgaaaaaactatcttttgtccattatattgactttgcttctttgtcaaagatcatcggttgacaatatttatgtgggtctacttctgggctccctaattctgttccattgatttgttcattcttttaccggtacagtactcttacttactgttgtcttatgataagacttgattttgggtaatgtaggtcttctgactttgttcttctcctttgatattgtgttggctatcgtggatcttttgcctcttcatataaattttagaatcagtttgtcagtattcatataacttgttgaaattttaattggagttgcattgaatctgtggagttggaaatgacttaacattttggcagtattgaatcttcctatccatggacttggaatatctctccatttaattgttctttgatttctttcatcagaattttatagtcttccttgtatagaccttatacatattttgttagatttatatctaagtttttcagttttggggtgctaatataaatgttttttatttcaaattctgcttgttcgttgctggtatataggaaagcaattgactttttttttttttttttttttttgagacggagtcttgctttgtcgccccaggctggagtgcagtggcgccatctcagctcactgcaagctcagcctcccaggctcatgccattctcctgcctcagcctcccgagtagttgggactacaggcgcccgccaccacgcctggctaattttttgtgtttttagtagagacggggtttcaccgtgttagccaggatggtctcgatctcctgaccttgtgatccgcccgcctcagcctcccaaagtgctgggattgcagacctgagccaccgtgcctggccagcaattgacttttgtatattaaccttatatcctgcaaacttggtgcaattgcttgttagttccagggtgtttttccttatttcagattttctgcatgtatgatcatgtcatctctgacaaaaagacagttctgtatcttccttcccaatctttataatttttatttcctttactgctttagctaggactttcaatacagtgttggaaagcagtggtaagagaggacatctttttcttttttgagacggagtctcactctgtcgcccaggctggaatgcagtggcgcgatctcagctcactgcgatctctgcctcctggattcaagcaattctcctgcctcagcctcctgagtagctgggattaaggggttttgccatgttggccaggctggtcttgaactccttacctcaaatgatctgcccacctaggcctcccaaagtgttgggattacaggcatgagccactgcgcctggccttttttgtttgtgattatttaagggggaatgctcctagttcctgaccattaagatattagttgtagctttttttgtagatattttaatcaatttgaagaagttctctattcctagtttactgagattgtttgacttttcactgttgaattttgagagttctttatgtattttagatactatatatggtttgcaaatattttctcctagtaaattttattgtcctatatttaagtgattcattttgagttaattttttatataaagtgtgaggcttaggtcgaagttcatcttttttgcctgtgcatgtctgctttctctggcaccatttgttgataaaactatctttccttgactgaattgtttttttttttaacctttgtcaaaaatcagttgggcatatttgtatgagtctatttctgggttctctattctgctctattgatacttgtatatatatcagtactacttgatgtctgtagctatatagtaagtcttaaaagtgggtagggtaattcaattcctccctcttttatttttttccaaaattgtttcagccattgttgttcttatacaacatatacactttagaataatctcagcttatttacaaaaaaacatcttgctgggatttgaataggaattatattaaacctatataacaattttaggagatttgacatctttactagagtcttagatctctccatgtatttagagctttgatttttttttttttttttttttttttgagactggagtctcgctctgtcacccaggctggagtgcagtggcactatctcggctcactgcaagctctgcctcccgggttcatgccattctcctgcctcagcctcctgagtagctgggactacaggtgctcgccaccacgcctggctaatttatttttttttattttgagatggagtctcgctctgtcgccaggctggagtgcaacggtacaatctaggctcactgcaacctccgcctcctagtttcaagcaattcttctgcctcagcctcccaagtagctgggattacaggcttgtccttccacgcccggctactttttttgtatttttagtagagacggggttttaccgtgttagccaggatggtctccatctcctgacctcatgatccgcccgcctcagcctcccaaagtgctgggattacaggtgtgagccactgcgcctgcctggcctttgtttttttaagatggagtctcgctctgttgcccaggctggagtgcagtgagccactgcgcccatcctctgggaggcttttaaaatagatttcttgggttttctatgtggatgatcctttgacatctgcaaatagggaccatttttattttttcttttcttatctgtgtgcctgttatttctttttcttactgtattatattggctagaactttcagcagtatgttgaataaaagtcatgataacagacatctttgccttgttcctaatcttagagggaaagcatcagttatttgagttgtattgaggctggctgctacgtcttgcagcaggggcagtttaatagcctccctgcaaatgactgaagcgacaatagtgtgacagccacttgcgtaagacgtttatgagaaaaggggaggaaaaaagccttgagagtaagcgtacaaatagctcagcttatagtttccaccacatggacaggattgttgccagaatcctgttggcttcatttgagatattttgaggttgttggcatcaggcattttgttcattttgtattgatactgagataactttttaaaaagtaatctggaattacacaccctaaatatcaaccatagaaaacattttttcttcttaaggaatggtctctgcagaaatgttttagaacgtattctgaatttttcacaaactcttccttgaatgcctgctgattgaatggatacaggtcgtacaggcaaatacacgctatttccatagtactgagtatattggactaaatctaggcaaaaagctgcctaaaatttatactgtaattggtcagctttatattatggcagccttctcgggggaggaacattgatttctagtgactgccactgagttaaatacattgttaatagcagaatcttttgtgtgtaaagagcctgcaacccacttctacctctgtgcatgtgtcttagttgctaacaggagaaacttatttcttcttgtgctttggaggacttgtctgccatcaaagatctagggattatacagtggatctgatcaggctgttgtctgcttttgagccttccaaattacatggcttaataaaatgattgttttctgtgctcagaatatttctgttgtgatccttatacttcattttctagttgaaaaaagtgttgttttgcctttgctcttatgatacaactaatacatttttattggtaggaacagtaaaaggtgcataggtaaaacagtcatacttaatccttttggttaacaatgaattaatattctgatgcctagcacctctaagctgttttctttagacataagttttataccgtatgttctgtgttgtaatctttttatttcatcatgaacatctttgtgtattacatagtttgcaatatttttaacagttgtgtgacattccattttaaaccagtcgtattttggacatttgatcttttttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttattttcaattaagagtttgagatgcttgtaaaagagaaaaaattttcattttgacctgatttggtttcagtcttgtgcaacatagggatgtgggccagtttgatctggagagattctttacctctctctacctgatagctgtgcctctgagttggcatagcatcataactccagtgtttttactttaagcattttgcattgctcttcattctgtattgtctgtgtccaagcttgtagagctcaagattgtagctttaagttctcacttcttttgggattttcttttttcagatcgtaaagctgaaaattgaaatcatgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctagaaacagtaagattttcttttgaacttccctggatcaaaaaaatggatagccaagagaccagtggaaagtgaacaccgatcagttagttcttcgtagctgtgtgtgcctgaagtcagctctcaggctgctgtgcaattccttcctatgcagaaaggatgtgtggtataatggaaagagcagatatgggttcagatttttaatgtacttctgggatcttgcaattttgttttttagaaaatgaaagtggtaacatctttcttactagtttttttgttaaggccagtgttttagcttgtctttattactgattcttaatcacacaattcagcttaacttgtgtattgggtggtcatatcaattaaccctttgtcgacagtagaaatcccagctttaatctagtaatattccaccagctagcttgaactgctttctaaggttgaggaagtggtattgcattgtgatagtcctgttgaccccttgtgcttagttcagagagcacaagctttgaaattagacctaggtttgaatcttaccagacttttgtggctgagaggttattaacttgcctggtttccacagctgcaaaatggggctgaaaattttttccttcttgatgtgaggcaattgcttagcatagtatctggcacataagttagttcatatcgtaaatacaagccacttggttttcaaaaaatgtaaaagtacctggcaagtatcaccaaaagataacaataacattttgctgcatttcttccagttttttttgtttgtttgtttgttttgagacagggttttgctctgtcacacaggctggagtgcagtggcacgatcacagctcactgcagccttgacctcccagctcaagcgatgctcccacctcagcttcctgagtagctgggaccataggtgcatgccaccatgcctggctaattttttattttgtgtagagacaggatcttgccttgttgcccaggcttcttccagtcttttaaaaaattattacatgtgcacacacaattatcctgcccttttcatttagcattgtactaatgagtatgagcagcactttcttcatatacccttgtcagtattacagattgtcttttaaatttttgttaatttcataagtggggaagaaagtatttcactgttctatatcagttatcttcttgtgccattcattttgtatctgacattggaatatcagtgtttctcttactgaatgccatatatattgaacgtactcattttcatatctgttggaaatatcttcatttgcttttgattttgtttttgatgtgttttggcatctagaagttttgacaactgtgtacttgaatgtcttttactgaaggacaaaaagaaaacttgcttaagaaactataatttaaaaatttaaagtggaaccaatgtaagaatctactgctacgagaatagaagacctagaaaagtgatcctagtgtatataagaactagatatatggtaatagagggattataaattggaaagaagggacagtattaggaaaccatgctagaatgattatcttgtagagcatgtgggactattatattgcgataaattttagataaaccaaaagtcaaatgtttttaaaagaaataagctataggagaagtagaacatgtaggtgaatgtttactttgtcttaagtgggcatggtctttccaagcattaaaacaaaggaaaaaaaccataatggaaatgttaaatactgtatccaaaattaaaaagacatgacaatagccatcctaataggtgtgaagtaatatctcattgtggttttgatttgcattcccttgatttccttgatagggagcacctttttatatattttaaaactatttgtatgtaaatagacatctggataaatgtctattcaagacccttgcccgtttttaaattgtgttatttgggatttttttgctattgagttgcaggagttccttatatattttggaaattaatccctggaagacattaggcaaagtgaaataagtcagccgcagagggacaaatagtgcatgaatcctcttatatgaggcatctaaaatagtcaaaggtgtaaaggtaggcagtagaatgatagttaccaggaaatggtgggagagagaagggggagttgctgctcagtgggtataaaattataccaggcaagttcgttccagagatctgctgtagaacaacatagtgcctatagttaacagtcaggtattgagtatagtctgccctccgtgtgtgggttccacatttgcagatggaaccaactggatagtaaatatttgggggaaaaaacaataaaaaagaacaatacaaaagtaaaaatagaaattttgaagcaatgcagtgtaacagctatttacatcgaattcagtattgtaatactagagatggtttaaagtatataggaggatgtgtataggttatatacaaataccattgccattttatacaaaggatgagcagcatagattttggtattcatgggggtcctagaatcaatccccagtggatacagagggactactctacttaaaaatttgttacgagggtagatctcacgttaagtattcttaccacacacaatcatgcacacacacgtagggacacaaggaaacttggaggtgatggatatgtttattacctggattgtggtgatggcaacgtgagtgtatacatacatccaaactcacccagttgtatgcatgaattacgtgcagtttttttgtataccatttaccccttaataagctcaggtggggtgggggagggggaagacacatgacaagctggggaaaatatttgtaacccagtgtagttaatattttcagtagctaaatcaggagaaatgaatatcccaatgacaaaatgggcatagggcatttaagaaaagaacaaacccagtaaacgtccagcaagattcaacttagcgggtaattggagaaatgcaaattaaaaaacaatttttaacctagtggattgtaaggggttgctcttggagtcatatactgatttctggctcttatttcctagttactagcaagttacttagcataaactcctagaagtggaatttttatgtcactggttatggacatttttaagacttgagttgtctattttccttgagcagcatacatgattgcccccatttcccatactgtggtcaatgctaggtactattatgaaaggcttttattgatcactttgtgtatcagtagctgtgcaaaggattttttccccagatttggtatctattgaaataaatcactgtaaaccctggcaattgttattgagctatcgaactggcaaatgctttcttatatcttaacgttgtgcttgctgctttctcctgcaaaatgcaagggaccttgatagtctgataaaacagagaccatagtactggtacattaaattgatgccattatgctaactggatcttgtgagcagaaaacacaagcacaccttagatgcctcagacatatttgtgccagagagtcagaaacaaaccttgtggaagcttgagggccttttcacattaggaaagtttctagtggccccagggtttgggaaatattgggatatcccttctaaagtgagagggaagttgctgtaccttgtaccacacactgtgaagaaagaggaacaatgtgtgatgcgtttggattttggagccaacatattggttggtcacatttaggcatgctattttgacctatttactggataacctctaacacatttagtggggaaccactaaagtgttagtaaggtttggatctagaaaagactctgcaaaaggtccaggctatgatacaagttgccctatcacttggacattatgacctagtagacccaggtgactgacttaggtgtcagctaaagatgccatgttgtgcttttggcaagccccaatagaattacaagtaagacccctagattcttggctgtgctgtcctctgccaccagctattctacattcacaaaagcagcttctggcttgctactgggccttggtaaagactgaatgcctggttatgggacataccaaattattacaggatccaaatgttcatcatgaactgcatcttacctacacatcgtaaaattggatttgtacagctgcattccattagaaatagaagtaacacgtttgatgctggacccaagtaggtccagcaggcacaagtgaactgcataagcaggtggttcaaatttccatgttatctatttctgctgcttcactgcctctccctcaacttacatcttagaggagaagaggaaaaagtgcaggcctggtttatggaaggattttgtgccaaggattttacatatatttaattaccatgaacatttgaggtagatcttaataatgcttagagggagaaaaggtttggacttagcttaaagaaacccctgttaggttccatgttgtttcagatgccgaaaatacgtttctcccagtttgaatctcacgacagcattgctggatatataggtacatgttagtttattttgcagaagaggatgctgagattcaaagaggtagcttaccaactacctgattccaagggtcatactctttttaatagtatgctgtctctgaatatttaagctcctgtaatgggagataagtattttatgtatgtggcagacgtttgagtttcatatttgtgaggtagctattaggtctgtttttctgataagagagctgtggcttagaggttagacttgctcatgatcaaacagcttagtaaacatgaagttaaaaagtgaatccagacttgtttggttccagacctctggtccattcccaggatgctgtactgcctttatggagttaaagaacaagtgtaataatcacttctcccagctgccattcattaacggaaggcttctctctcccagcccctatccctttccctccttccactttcagaaacttgactataaatgctcaatccactccttgttacctgacaaatggacccattcatcagtagaagagagcagaaatgtatggaaataggaaccccaagaaagaatggagtcctagttttacgaagttcggaagctgtttaccatcttacaagtgaaggattttatgtaacagaaaaatatagctagtgctaatcttcacctttaattgtgaattcactaggacttttcagtctctgattcaatataacctaccaggcattctggttaactttcagaccatggtatagattccttaattgtttttttttttttttttagatgtttaacttattattgtttttgttgtcagcacctttccaaatagtttgtctgcatctacctttatccaaatccaaggtgggtttttgttttgttttttgtttttttttgtttttttttgttttttaagcccaggtggattgttgggggaataaaagcattttctcatgaggtttccattttaatcccaagagattgtctggcacatctcgttttcttaagtagtaaatcctagcaaaaggaaaattgctgtgtgagcttaagggttccttttctgattctccttatttgcaactccctcattccaaaacatcttttgtgaatacttttcttttctcagcctgcagactgcagagccttaatagacaaactcaaagtttgtaatgatgagcaacttctcttggaactgcagcagatcaaaacatggaacattggaaaggtatgtgaagtcaagctcccaaaagacaggactcaccatactaatacatcattttgtatgctctgatatggaataagaaaccacaatgggatagcctcattcagcaattaataagcatctagcatgtgccatgtgcctaacacagctttaaaccagtggcaaggaaaattttgctggctgaggatggagaattgatttcacaggtgatgcttaagaatctcaatcacagaattcctgtggtttgacaatataagtttgagataatttctggatttttagtttagaagaatttttattagataactctaaaaatgaatttttctgataaaatggattctggcaaggatagttctcttgtcttcgtagatcttagaatgtaaccggagttctccatctaaagacctagctctaggggttttatggtgtctattggtgttagcacatatatctagatgggtatgacaatgaactacagcacttttagctcagagtatgatctttctcatatgggcaagggtgggacgtgaacttgtctaggtgtcatgctcagcaatctcttgtaacaaagctcagttagaaagcacccatgcggcgcttctaccttattcttacatcctctttttcctcccctctccagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagaggtaggggaggttaaagcctgtgtaccctgttcttgactagaattgtgtacatccagaaataaggaaattgctatttctattgcttctttccttttcattgtggagctctgggtttttcattgtcaaagataatagtagaatgtttcttggatatagatactatccttcatagggttgatgggaagattctgtactatcacctttgctttgccttttcaagattcaagaaatgaatgagaaatgttatatatgtattaaagtatttaaggaaatttgcatgaattgatttttgccctaggttgttagagcagccccacattacttttaaattcctagaaatagtttgattttctcatcacattaatgtacttactactcctctaagtgttagtgtgctgctttaaagtctctctgtactctgccacacccatcccaaaatatatattcatagcatcctttgtgtccttgaagagtaaggtaggtgcagcaatcagtgagctttttaattggttaaaaatcactgtaagaagaaattattttctttttatagaagcccaactttagactttttatcatcattagttaggtgccctgttaattttaggtgtgttttcctacgtcttcagtagagaaacagaatcagaacaaacaacttaaaagaaaatggcttaggaaaagaagtgggataactgaactaaaggcctaacatacagagctttaagtgggaggtaaataggcagtctgttgaagatgaaatagatatgctgcccatggaagtccatgaccttcggtataattggcaactggaaatgccttggttcatttctagctatattacatactgattttaattctgaccaactgcttcaatgtattggtgaattttaattgtatttaaaagccaaagtaaggccaggtgcagtggctcatgtctgtaatcctgacactttgggaggttgaggcgggaagatcacttgagcccaggggttcaagaccagtctgggcaacatagtgagaccccatcgctacaaaaaatacaaaaattagcggggcgtggtggtgcgtgcctgtagtcctagctactcgggagacttcggtgagaggattgcttgaacccaggaggtcaaggctgcagggagctatgatcatgcctttgcactccagcctgggcaacagagagaccccgtctccaaacagcaacaacaacaaaatccagagtagtcactcaggttccttatgagcatatactgtactgtaacacttatatgttatataattgccacgagctgttatcgatatctttagcttctatatgaaggaccctgttttaattaatttcaattttatgtttgtcataaaggatacagaagagaacataaaatatctttctttcacaatacttttagtccagttagagacttaatgttcttcttgagtcccacatgtgtatttgtctcttttccttcctgtgggaaaacctgcgcaattttgaaccactatttacgttttttacttttattgcactttatagctaactgccagattttaagctccttggggataaggttgcatgttgtagattatcaaatacatatatatatatatatatatatatatatattttttttttttttttttctttttttgagacagagtctccctctgttgcccaggctggagtgcagtggcgtgatctcggctcactgcaagctccgcctcccgggttcacaccattctcctgcctcagcctcccgagtacaaatacttatatattttttgtattgttgtgactaaacttcttgatagctttgtaaatgttgacaagtacattttgttttgttttcaaggccagttgtgcctgataccttgagctttgcccttttttgtccctttagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagaggtgagtcttgggtgaagagttggaggggtgcaaaaattggagcatatggttcctttcaacaggtgtttcttggagtgttaaaatatattagaatccctaagttaacttcactggcctaattgagttagaactattggtgccctgttttaaaacctaagtattctcagttattaagtaattttgaaggaattctttaatctctgctcaccaaacaaaatctctctgttcaaaagtggcaatttcacttctgaaaggaaagttcaaaattagattcaattctgtgtgagaaggaagtataatgcaataataagatctagatttgagtcctggccctgcttactagcgccgacactggtttcctcttctgggaatttaacatatctacttcagggttgatttagaatgaaatgaattgtggggtactcagtgctgtgatcagtaagtcgtagtgattgtaattgaagccagaagctctcatataaaagttcagctctaccaaactattgtccagtgttcccagaggcaacttcttaatacatacttagctttgagaggtaacccactgttggaaagctttcttagaagaaaagtgttatggctggctttttaaaagcatatttaatgcttacctcaaagtaattcaagttttcaggctaattcaggtgccatgattacttataaattagttttgtataattataaatataacatgtattctgaaaattctaggaaaatgtagacaaaatgtcaatcacctataattcatccctatgagacctcccttaaagttggagcatttttttcttgcatttggaaacacatgtatacatgcatgtgacctgttttcttaagatactgtaaatatttcctcttactattaaaaaccacaaggaggtttaacattggattcccaagtccacagttaaaaggaaaaaggaactattactcaatagatgcttccaaagcactcgataaaatttatctcattaacaaaagcttcatataaactttaagaaaactagagttacctaccagaagtcataatgggggagctgaggcatttccattggattcaaaagtcacacaaaaatgtcagacattaacttctgtcatttacatttgtagtacagatgctaaccaacagaaaagaaagaagcgaagaatacatattaaaagaaaaaatttgggctgggcatgatggcttatgcctgttattactggcacttggggaggctgaggcaggcaaatcgcttgagcccaggagtttgagaccagcctgggcaacatggcgaaatcccgtctctgcaaaaagtacaaaaatccgccaggtgtggtggcacacccctgtggtcccagttacttgggaggctgaggtaagaggatcacttgagcctgggaggtgaaggctgcaatgagccaggatcgtgctactgcattctagcctgggcaacagagtgagaccgagactctgtctctaaaaaagaaaagagaatatttgttactatttgtatgtaggtgatgagtctctttgtttcttggggagataatgtaaaattattataactagtaaaagcacagtgaggtagccaagagatcaatatacagaaacagatagctcttccatgtattaatagcaaccaattagaaaatgattggtgaggccaggcgtggtggctcacgcctgtaatcccaacactttggggggccgaggcaggcagatcacctgaggtcaggagtttgagaccagcccggccaacatggtgaaaccccatctctactaaaacaatacaaaaattagctggacgtggtggtgggcacttgtaatcctagctactcaggacggtaaggcaggagaatcgcttgaacccgggaggcggaagctgcagtgagcctagattgtgccactgcattccaggctgtgtgacaagagcaagactctatctcaaaaaaaaaaagaaaatgattggtgaaaagaccccattcacagtataagcaaatattctgtctgtaaaataagtcatattggctaaaactgtaaatttaagagcagttaatgtaggaggttgtgttgtaataacaatggtggggaaagaattcttaaaatccccatggcataaacctgaaagtaaaattttgaatattgtatttaaaaatatacttcccaacaaaaaacacatagctccaggctactccttaggcccttacactagaatataaatcaacacactgcttccttcatcaagaaaaatgtcagttgtactaaatagtatagttaccaatgtagttaaataacattctggtacaacctcattttgtcatggaccaataaaacttgcaaacaattggtgtaatagcaagcagctggtctgcatacaaaattaggcagcactttgtacaacagaagttaacagacccatggtagattaaaaatgtttaacagtgttttaaaactgaaaagggactgctaatgtagaatatccaaggaactcttccagatcaacaaggatgagcaaaggatatggataggcaatttatagaacaggaaattcatgtgagtagatgcccatactcagtaattagagaaataaaaataaaacaaggtacagctttgtaagcatcagatttgcagaaattagaaaactatataatggtaagtcctggcaggtatgtgaagcaatgggaaccctcatacattgttcataggagtgtagactggttctcatgggtatatatttcaaaggtgagatcgcatcatttccataaacgtgatctctgtcagagtattgcatcatcatttgtggtagtgaggagttggaagcaaccttggtatccatcattagtagatactcaaataagtaaaatgtggcacatgcacactatggagtatgtagcagttagaaacagtggaccaaataatacagcaacattgatggcttctaaacatagtggttagtgcataaaaaagtaaaagcaacagttttcattgctcagtaccatttctgaaacttaaaaagatgtacacaatgcaacatatagtttcaagaaagaaaaattaacagacatcaaaagttatacctttgatagaagggaatctgaatgggcaataatgggacagatacatgaacaagtacagtagtctccccttatccgaggtttcgattgccatggtttcagttacttgcagtataatacaataagatatattaagagagaagccacattcacataacttgtattatagtatatattaaactttatcatcagtatgtatgtatagggaaaaaatgtgtgtgtgtgtgggtgtattatatagggtttgccactacctgtattttcgggtatccactaggggtcttggaatgtatccctatggataagggaaaataaatcttaccagcagtatttaagatctgttagaccaacactaaacctttacttacagatttaaaagatggtctaaatagagacaagtaacattttttaaatgggaagacttaatgtagtagaagccctttaatgaaattaggaccaatgattggtagtttaattattttaaaaatcttgttaaagcaggaaatgtttaaaaagtgattgatacatatgattttttaaaaactaaaataattccctttcccatcttatgtgggccataagacttagtaagaagcagtctgttttctgacataaactacaactataatctgtgattactttatggtgttgcaccgattgaagaaaaggagcctgcatacaggattctaaattttttagagtttacccctgaatctcttcataatttgacactttttattttagcatcttgccttttagatgaatattttgcaaaatattcgacttagtttttgtgaaataattccctttctcatttaaatcagtcaaattgattaagtggaagtctgttaatagcatcaactgagacacagaaataaatgagaaaacactgataatgaatcagggtgagttgctgtatcagataatatcataaagctatagtggttttattataaagccaagtttttatcataaggctttttatgattaagccaagtcttgcagttggcacaggaatagacaatacatctgcaaaatgaaagagtataccttatgttgcttagaacagtgggacagtaggctgttttgaggggaaaatgtgtttagaacttttcttcacacttgacataaatcctaggaacgtatttagaggtaaatacaggtgacttttaagatctttgataagagtttgctaagaaagttaacagacctagaagtcattaaaaatacagctttgatcatgttaatttggttatttgtataggaccacaatagcatctgacagaattcacatcaccctacttttaggctgatacaaacacactaatatttcatactttaattaaatgttctgacaatttaagtagaagttaaaatgcaaactgtttttggtataagtggctcacatatataaagtatcgggtatgtttctttgttttgttttttaggtaattcagatccagttgttgttcttcctttggatgattttaccacagaaaggactgcttaaatgattgcttttttgtccctttgcatttttgacactttttacctttgagaggcttgctactttttgctctgaattgatctaaagagattgtagattggaggttaatttctagtcctggagaatttggaatcttgacaggtgcagtacattgcagcctttggtaatagattgatgtgtttggtgctttgcaataaaagatttttacaggtttttgaggtttagagataattaggtatttagtaatggtacctccaatactaatatccctcattaaaatttaaaaatttcatgtttctctaaaatgtaaaatttctctaaaaacttgacttgttcatgtgggcttcttttatttatgtatttattttttttgagacagagtctcactccattacccaggctggagtgcagttgcacgatatcagctcactgcatcctccgcttcccaggctcaattgatcctcccacctcagcctccctagtagctgagactacaggcatgcaccaccacacccggctaattttttatattttttgtagagatggggtttcgccatgttgcccatgctggtctccaactcctgagctcaggcgatccactcgccttggcctcccaaagtgctgggattacaggcgtgagccactgcctgtccttgtgggcttctttaacaatgctcatagaaatcttggttcatgtcttttcagtcttttcaggcaacttcctttgcaacaaacacattcacttgcatgtgtataagaacctggatttggatgtgaaacctacttttgccaacaaatattaacctgtttctgtgtctgtaaattgggggttacaatatctacctcatagtttttttaggatcagagtaaaggaagtcataaataaaacctgtagggttaatgccatcatgttggaagtacttaataaacagctgtcatttgtagatggatgtcaaccagagaaactacatgccattcttttgtatttgctttcttttaaaatgttacacatgcattattttataagtgcatgcatattgtcacatgattattttcagtacagccttttccctcttggttcacctccccataacctcaaatgtattcttctctatatattatcttcatattatattgactgttgagggtgtttttgtccttcagttacaaatgcaggataccttacatccttgttttcttatttcagaccttgttcaaaaatcactttaaagtcacctgtataactatagggttcttttgatggctgcatagtattccatgctttggatgtaccatattttactcaagttccctattgatgcatacttatatttgttatgaatgatgctacattaagcaatcttatatatgaatttagttactgatacatttaatatgatattataagagatgatatggagatcataagatagagtcccagaaatctcagtgtgactttattggcacttcactgatcagtaatgattttgagcatctttatgcttggccattaggatttgttcttgtgaaaggttttatcttttgtccatttttccatttggttactttttcctactctgtaaaaccatattggagatattagtcctttgtcatcttaaaagtattttttcccctaatcttcatgtatattgtctttgtttattgtgttttgtatgtgatgttttcaaaaatggttcagtcaatgcttttatataaaagattgaatatcgtgttttggtctttatgaaaagtgactttggatatggtgtctttcctcatagtagtttttaatgactaggtcaacccagtgatgtgggctaattgtgaatgtgaacagtgattagttaactacagatgtagggaaaattctccagaaagacttgttgaatcagttgaaagccagttggctggcttttgtgaaggtctggtatactctaggtctagtaaacttgaggatgcatcagaatcactttattaaaaaatatattagtcttcctcacctccatcccacctaactcctgagttgctgattcattaggcttggagtgggcctcagaatttgcattgctataaagttcccaggtaatattaatactaacctgctggtccagggagaaccactggcctagtctattttattaagttacaaacttttatcaaattcttataattccatcttagagagcatcaagcctttttcctgatgtctgaatatttagcaaatcctgtctagtgtgaggtagtgttgtatatgcctctgtggcataatgaatatagttatttatgggttatctacttaagggctaggatgttacagtaacactaccagataggtgaatactgtgaggctcagaagttacttatgtattttttttttgttttttgtttttttgagacggagtctcgctctgtcccccaggctggagtgcagtggcgcgatcttggctcactgccagctccacctcctgggttcatgccattctcctgtctcagcctcccaagtagctgggactacaggcgcccgtcaccatgcccggctaatttttttgtatttttagtggagatggggtttcaccattatttttggacaaaggccctgggctctttgcttctgctaaaatgtgaagaataatatctgttcttcctgtcttaggcatttggggattctttgagcatggtcatgttcgtttttttaaataaaaacaagcttacttagtacttgagaaagcaagataaatagataataaattaataataataagggcaaagaactagtgttattctgaatagtactgactaaaaagtaccctagaatcttaacatttaatatgttgattttgttggcagcgaaacaaacttgtcttcctgataaaaataggtgcttggtgttttatgtatgcaacaaaatttatcataattgtgtatctactcattttggtatattttcttagtctttatctgatgaatatttcttcacaagaaacatttctttatatttcatataatgttactagttcataaatataacaacagcacagactttcgtgagtcacgtttgagttggcagggttttttaaggatctcagcttaccaaaactttctaattaaaggtgcttgttttttatcaagttgcaaaagttggcaagaaggattttgtggtgacactaataaaagtattctgaaacaattagttggaataacagaagaaacaaaaggaaaataattgtgtagatacacagcctttcaagcttattctgccttgcagattcagacttttggtttgacttacctgtctgttctctgtagcatcaagcctttataccctcatccttactttatggttttcagcaaattgcatgtgtcttcgtcttcactagatgtcctgggaagagccaagaaaatattgaaaatgtaatgaagtacttattaggtattaaaccattttataaagctatagtaatttaaatagtgtggtaattaagagtggaattgaccaatcagtaggttccagaagcagatccaatgtgtaagaatcgaatttatggttaagatggcatttcagattagcagaaaaagaatggattattcaaataagatggtgttgtaaaaactggcttactctttgggaggcaattaaggtagattctacctcatcaaagtaaaattaagatgtaataaaaagctgaaatgttaaaaacatgaagttatacaagcattgaaagaaagtataactgcatggttgtatgctgcttgaagtggcaagatattttcaagaatgagactaatgccatgaaagaagaaattgattccattacagtatgattttataccttctgtctgtgaatattttaggtactgtcaattgtgccatctatggttatctcaatttacttcacagttttcttcttacttaggtaatttccagtatttttctgtggtaaataatgctacagtgaatatctttaatacgtgactatttggccatatttagcaccaggtgtttgttaccttttttggggtctcactctgttgcccaggctggagtgcagtggtgcaatttcagctcactgcaacctctgcctcccgggttcaggccatcctcccacctcagcctccctagtagctgggaccacaggcatgcaccacatgcctggctaattttgtatttttagtagagacggggtttcaccatgttgggcaagctggtgtcgaactcctgacctcaggtgatctgcccgcctcgggctcccactggctgagtgctgggattacaggcatgagccaccgcacctggccgtctgttaaacatcttaatgaatgtcgaaccttgtattttacagattcttgtctcattgccttaaacttccctagttgttttaaacttctgattattttttagagttctgatagacttgaattccgacagtcagtttattcactgtttttgtgaaggtgtgggcttatggggttccccattctgccattttcactgacagcattcctagtagaacagtctgtttttaaccagctgggagtgggggatatacatatctgtgtccaggcagactttctcacttaggttttcactagagaagtaagccctaatgccctaaggtatccattattaatgtagcaaagagacttctctcttgtgcatctaaggtggtgctagttatgtaccattatttggagaataaaatgatcattcaccatgttctgtgtttcatatatgatacctggattgagaaatgctgccagtagatcaagtgtagtttgagaaagcttatttctcacaggatagtcagatgatgttttatttattcatttatttatttacaggtttagaaatagcattctatagtatgtacctttgtgactggcatcttcagtggtttacactgtttgtttttgagacttctttggcaagtagtgatataatagcatttaacaaagaggaaacacttagatgtagagagagagccatgttagttcatggtggcagcccagatccgaggtgattgggacccacactagacaggaataaaatgaagacatagaatataagtagcattttgtgcttcaatcatgccagacttaaaaatatgataatgcttggctgggcaaggtggctcacagctgtaatcccagcactttgggaggccaaggcagaaggatcacttgaggccaggaatttgagaccagcctgggcaacatggcaaggctcctacaaacatttttaaaatgtagcctggcgtggtggcagcatatgcctgtagtcctagctgtgtggcaggctgaggcaggaggatcctttgaccccaggaatttgaggctgtggtgagttgtgattgtgccactgcactccactccagcctaggcaacagagggagaccttgtctatctctcacactctcttcatatatagctacatatatataatttttatttttataaattttatataaaatttatataatttacatatttataattttttaaaaatatacaaaatatctttttatatgaaatgttttatatttgtaatataaaaatctcttcagtttgacataacaaattaataaatttgtttcaaataatatctcatttctttcacttcgtcaattgtttgcctgaactatatgccttgccccatgaggcagggagatatatattttttacatatataaatacatattttatgtaatatatgtaaaataattatgaatgatttaaaaataaaaatacgttaatgctcttaatgttaaagtgatattttaaaggctgttaagatgcaggctagttagtaagtgagactatgtggctgaagttttgtatttagaagccagttgagccactccccccattatctcaggagcttgttgatgaggttttagatttgagtggcaaagtacagtagtaataaataaggtagaatctgctttgtaactcagctcatgtcaaaaagagaggaactggaaagcatgatttcctccctagtgctttcctccctagtgcggaaggtgagtaggcagagcctcaggcaaggcctgataggacaggagggacctgtcagcacacgtgactacaggggtatggaatataatggctggcagttgctgcttgagttcttcctaggagcatcctcactgaacagtgaaattgatctcattgaagaaatcacctttaggcagaccatcttgccttgattcttaagttcttatttctgttcgttttttcctcttgtttgactttcacattggatgtcttctcaacattatgttccaagcagccacacactcttaaatatatatatgtatgtgtatatacatagagagaaagagagataaggtctcactctgttgcctaggctggagtgcagtggcgcaaagtcaccataagcactgtcttaacactatctttttcctttttcaagagctggggtggaaaggagaatggctttggacttgcagaatgttgcagagacttgcatatgatggtaagtaactctttgggatatgggtgtcttttgacagagctgtggcctctctgtgaaccttactttacaatgaattgtggtatatgaagtgacgccttcacatcgagacctttgaggaacctaagatcagttcagacatagctgaaccacgtctataggaagcagtctagcagtgcttgggctcttgatgtgctggtggtagataaaaaaatctgagaaatagagtgtgtgttcatacccagttcttgagtaggtagctgtatttgttgaattaattttaatgtgattttttttaaatcccagaaagtatgttcgcttgcattctcacactggaactattgtatcagaactctggacagtgtggtgtgatttaggaatggctgcttggagagcagttctaccattaggtttattgagaacttataatgttttatgtgctttccttgtttatctctctgcctttcacccatgtttaagttatgagctcaggccatcctcctttctgctttgatatgttgctgtggagctacaaaacacaatttgattttcaataattattttgcatctggaagcaactatattttccacgtgggatttgtcttgtcagtttgtcgtgtttagcacaaatggctgcagtgaaatttagtgtatttatcttagcaagcctttttttcctaaagagaatggctcttttctggtctcagaaaaccacagattagatcaagttactttcccacgttagctggcatacttttctttagtgattattttatgaagagatattgggtgatacagtaggtgagtgttgtctgtttaataatcaaaactacataaatcttgaagtatattcagagtttggaattctaattatgacaacataaaggttaacgtgtactttaaaaggaagtaatacatatacatgttaaaaaattcagagtataaagaggtatgcagtggtaacttcttaattttccagaggcaaccactgcaagtggtgtctttcagtgagacattttagtgggcattctgctgtcatcttaattttgttcatcatgttgcttttctagagttaaagagaatgttttgtcagggtctggtttatgttgtcttggtatctacctgtgcagaaaacataccatgagaagtggtgtagaatggtatagaaggaaagtgtttgaagaattatgaagatatgcctatgaggcatactttgaattaaatatttcagaaggctgatgataggtacaaggtttttcgtaggaatgttcttttccattctttagctggtttctgggccctggtatttgttctccatcctttcttggattcttattcattactgcttggcagtcttgcccctcttttcccccttgggaatagccacagtcaaaattgatctcttaaagggaaactggaaatttataagtatgaaatgcagaaggtttgggagctctgggctctgtccttttgattctgtttgaaaagtctcatcctatctgagctctgctctaagacaaacagttaaaggcactgtaggtactgaatgtactgcttattcttctgccacaataagttgaacaagtggctaggactttgagggaagatgtgggggataatgtttataatcagttgaaactcaatgtctgattctttgatgtgctttatacacagaaatatccacccagtgcaactacactacactttgaattctatgcagatcctggggccgaggtcaaaattgagaaaagggtgagtctgattcagatttgttctgacaaagtctacaatttactgtaactgggattgcctcttctagaactcctcagttaaatgaataaatggttttgagctacactgctgccctcgcaaactataaatatacctagcagctcctcaggagtgttaattgcatccccaactctgatagggttgggtcttatgttgggagctgccaaaagatgcaagtcccatccattatgaggcactgctatgacctatgtgcttttcccacagtctctgagaattccaacatgtagtatagtagtttggatggtgatggctcaggtttctctaattaggaagcctgcaaaagtctttatgtattgtggatagtgtcctgcttaaattatctggtcattttgtattgtttgaggaggtactaaagagtttggtttagaagta

SEQ ID NO: 5689 - DNA, 54667 bp, human; identical to SEQ ID NO: 5688

SEQ ID NO: 5690 - DNA, 36730 bp, human
tccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtagctcgcgggtggggggtgggggggcagtgactagggtcggtccgcctgctgttaagatggcggcggaggctgatgtctgtccggccaggacccagcacagaggtgttggctatctgcctttatgacgcctctgaggtgcccagcgttaaggaggtgacgattggcgaaacgccggggtgccggtaaactagacctgaggcgaagaccacctcgtttcttgtccgttgaggcgacaccatttcctgggcctcggccgcgtgtgggcccgcctttgccccaccgatcggtcaacgcctccgttgtcgccgccgcagtgggcggattgggaagggtgggaggggagtctggagttcgctggggagtggggttgggggttaaattgaacggtgggaaagaggagcaaccaatgaagagtggcccctttcccctaccttttctgccggccaacctccgttctcagcacctccgacgacccggatgaataccctggtttttctcgaggtggggtcatcttcgccaactctcgcggttttagagctaaggcttagggttcaagcagtagtgtcactggtgtactcctcctcctctccccacacccctcctaattctgtcgtcccatctaatcttcatctacgtggatagttgaggctggtatttaagggaggggggagtcaaagcttttccctgtgactccttccccagttctaaattcgagtttagcctaagtcctctagcccgctctgtctcccccttccattggtccccttggcgcaggcgttgaatagagcttatcctgttgcctgcatttactccatctttgtggatggtgccatagtagccttccatttccttaagtcttcatgtttgtatgactctgatccggatttcttagctctgcatgctgctaaaccactattaagcgaaactatgaacgggtcggtgtttggatattgcagtttaagtggccttttcgtttacggccattagccttgccttcctcattcctccccctcagaaggctgtagaggataactctccagtaaacccgctttctgtcttccctgcctcttccatttcccctgcaagcctgggaaccgccccttttccctgccttgctctgagtttctggagcctcttggtctgtggacatctatttttgctgctgagcacctcttacctgcttctcacttcttaatctttctatcccccactccccatactccttttccaggagctgaatcccttagaaggaagataaccctcctctcaggctccactacattttaccccttccatttactagaaaacagcattgattgtcctgccccccagtctgccctgttctttatttcctcttccccccatgccaccgttactataggcagttaattccctatcatttgtttctcctttgtagattacatgttcagcattgttttcttttagccccagtgttgcatagattgaggagataccaacattccccagtcataggcggcggtctggtatggtgaaattaatagtgtgtgttttgggtgtgttttgggttcacattgaaccttgtgaccttgggcaaattttcagattctcagttcatctatataatgggaatagttgtgcttacattagaggattgttgctagaattagttaaaataaaataaaataaaatgtttagctcatggtaggcacataataaattaggattactttttggtgtaagaatgcattggtagatgtacctgtgtcatatgctaattttatgacctgggaaagagtaagagatttttgtttctttaactgtacattcttggtgtatttctaggccagatctataacgtttatattttttttcctcataggccaaactttttatctccagtggttcatgatgtttgaacgtgattcccactctttgtttccttctaatggtctaggaatttcagtgcgtaatcactatcctggaatgaccaccagccataatgttcctgtcaagaaccacacccaagtgttctaccttttggaaggggtgcctcatgccctgcctactcatttcttccactccttcaaaggcagtctgtcctgtcattcactctacaaaagtaatttggtgtcatgcatttcacagtggtaaaaggaacttctgttagctagttttgaagtattcatgctacttttcacctccctcatttgtttggttcctcagatcagtgtggggatctgctatttggcatcttcttacctgagcaagataattcctgtccgagagagaaagatcatttggaatacccagcttcttttccatagcaaattactgctggctctttaatacactacttcctgttgtgttattgccattttatattttctaacgtacttattaaacagatgtgactatttgacttggagaaagttttccttacttttttttttttttttttaagatggagtcttgctctcgccaggctggagtgcagtggcgcgatctcggctcactgcaacctccgcctcctgggttcaagcgatttacctgcctcagcctcccgagtagctgggactacaggcgcgcgccaccatgcccagctaatttttgtatttttagtaaagacggagtttcaccacgttggccaggatggtctcgatctcctgacctcgtgatccgcccgcctcggcctcccaaagtgctgagattacaggcttccttactgttaatatattgattagaccaatattaaagtgtagcattttacaattttttttttaactaattctagcaacaaccctttaatacaagcacaactatccccattattttacttcggctgggtgatgggaattgaagtagaaacgtggtgaaaagtttactaggatttaaaatttacaggaggtaaccatcccacaattagctgtatgtggactctagtttcgaacttcagggtctgctttatttaatttgaagtgctttgtaggtaataaaattttcttccattttcattggagggcaggaaatcactttctgttttgagattttgcattggtgcattttaccgtgggttaagcagtgatcacaaatttattaaacctcaatttcaatttgacccttattgagcaatagaataaatctgggaatgataatctaggtgtgacctaaaagtttaacttattctaggtagatctctgagaagagaggaaggagtgacaataccaaataaaaactttgtctaaggttcaatggcaaagttcaacctgagttgccaggatgtttatcgtttgtctcccaatatggccaaaaagcatgtatgaaggtgaagaataatttttatatgtacagttgttgttttttttcacagaaacaatgaaacaaatacgtccttagtgtttatattgagggtataaacttgtctaaaaaataaactgtcttctataatttcatttgggttgagaactcagttttcaggaatgttgtctaagcgttagaagtattagagttgttggttctgaattcctcagttacttctcaaagcaggtcctaaaaaatgcaaatagatatgtaaggactattgctttagaaataataactagttatgtttgaacataatagaatggttaaccctcctcacacaccctaataaatgtgttgtgtatctcactcctctcccccaactttttttttgtaggtcctccagcagcctgacctgagtgggttagtgatccagagaaaccagcaggccaacttggtcaggaaggttcgggaagctgttggagcagtgtggggaatttcccaccaggatgagtatgattggctgtgattttaggttagtttttgtaaatcttgtgggaagtatttgtattttacttcctggaatggagatagtaggggtggatgtattcccattctgtaatggagctactttggtttcttccattctctggatctgatgtggtactggttgcttctttttttaaagtggagctcattactgaattaaagggaattgtttaaatgaatgatgtctgtacatgattttttaaatcaccctaggcatcgttcaaaaaataaaattgcaagtcattatgtctaaccagttcttattaaagttacgaaaaatttcaaacatgcaaacattgaatagtataataatccccccacttacccatcaccagctttaatagtatcaacttgcacattctatttcatctatacttctgtttgtttggttttttttaatttttttaaattgagatggggtttcatcgtgttgcctagactggtcacaaactcctgggctcaagccatcctcccttcttggcctcccaaagtgttgggattacaggcgtgagccaccaggcccagcctgtttcatctatacttctaaccactgcccccctcaatggattatattggaataaatccctgtcatatttatttgtaaaatacttgtttgtatttctaaaaggcaagggctctttaaatataagatcaaaactattatcacaactgaaaaaattaacagatatttaaaaatatcaaatataaaatgttcagatttctgatttttttttaagctttgttttttttcttttacagtttgtttgaatcaggatcctgagaaagcacatttattgcaaagcattgatacagctgttaaatctattttaatctgcaggttctgtcttttgttttttttttcttccaatttatttgttgaagaaattgtcctatatatagtttcccgccccccatatttggggattacagcccagtagtggtgtctaacccattcttgctcaattaaagaccctggaggacccattataatggaacaatggctataatctcctgtatcctagttggagttgatagtgctgtcataggcactatcctaaaataactagtcatggattcctttttctgtggcaaagtctgatttgatacctgacttcagttccatgtcttggccttgctcattgctccacatgaaaagtaggcctcctggtggaagaagctagtgtttcctaatgacctgattgtgcctttggggtttttcatgcatggtttcaatttccttaggtgatttagttatttttatactactttataatgttgctttttattcttttgatgttagtgtctcagctgttctgacccataacttctaagctattaagacctaataatgagttcctggctgtcatacagttcttgaaatggcaatactaaaacagtttttgagagcttctacttacatgttgattttcagctattatacacaaccttagttttcctactgtgatttttcatttcatttcatctgaaatttatgtttccttagcataaagtcctttaaggacttttaggctgctttatgatgatctcactatctataaggttgatattcataagtacttgggcttttggtgttttgctgtattattcgttgtttcctcaacgactggttactagatgtttatatatgttaatgtcaggaataactcaacttttaagtcgtttgatgtttcataggtggtgttgttaaaacttgatgtacttgttgaccagcttggtcttctggatatagaaatcctttcaggtagtgaagaagtggctctatgagtaaaacaactgtaggttttgtttgggctgttaacctgagcattttcaacttttaagttctctttaaaagtttttagtcatttggctttaaaaattacagttggtggcatagaatgatcccataatgtgattttacagaaagttggaatgttttaatttattatgaatgtaccattacgtggagattgggattgtagatctgattcagtctggattgctgattgaactagatgaatgttaaaattcttcaactctgagattctgatggtataatcttaggtattgaaagacagcagtttttcctttcagtagtcattaagtaaatggtgactaaaagtagggagatgaattattctggaatgacctttcactataaccatttagatttaaaagattgatgagtctgaggatactgtcatgaatttatgtaccacctttagcacaatccaggttttaggtccttgtgattagatatcagagataattgccccagaagtgcgtgggtatattacatttggtggctgttaatgttttggaatgattttggaagattactttgggtacattatttgctatgattattttcttatattcctgtctattttatagtgaggcatgtttctcctggtctttgctttttttttttttttttttaaacttccaatattctttattacggcattctgacaattgagttcttacaggtggaaagacctttcagcacagcgattaagaacatggactctggagctagattcacagagttcaagttctgactcccatttcttaccaggtgtgtcatgttgtgcaaattacttaactgctttgtgccacacggtccttcatctgtaaaatgatgataatactgcctgccttatagagttctgaagaaatttagctgagttaatgcatataaagtgcttagaacaatggttctgaaactttagggaacatcagaatcacctagaggacttcctaaaagattggctggtccccactcccagagtttctgattctgtagatctaggaggggccccagattttgcatttctgataagttcccaggtgatacttctctatttcctgcaaattggcagctggatccagagacttgataaatttcaggttcgttccctttggcaaatatattgcgggggggtggggtgggggggtgttcattcacaacattgattatgttacgatgacttgaattttttggatccattaatttgttggggggctacaaaatggtgacgttctgatgctatcattttgttttcatctgttagctggaataattttgtttcccctcatcttttatttggttactcagcaatatagtttatataggaagagcaggataaatactcaattttttaaaacattgctttcaagatgatgaattggtcccctgtcatcttcaaaaggttacacatataagtgtatatataactatgcatccatagatgtaaacatttgatgggtttcaatacattgcagttctgatccttagcgaagttcaaattgcccttcttgtggctagtggaactctcttaaagttggctcctgattcttactgacatgctctctagtagtctttgatagcttccttgctatctggtatgtcaagatgtttccaggcgcattcttgtgcatttctgccccagacctggaattagctaatgggattaagataaaaggtgaagtcaaaagaaattctgtttttgccaagggtagcttggaactttctatcaagttccacttttctctttccacttaacctccctagcctgcctcttcattcttctctacctttttattagagttaaggtggaaaggtttgagaagccttgataatcataggaagatcatggagcccaggcagttccggatttggggcctggccacttactaggtctgtcagtttgggcaagttaacctatatcagttatgatgtggggaaataccttattcatatggttattggaattaaagagaaaatgtaaggtgttagtacatggtaggtgatcagtagatggtaatttatttaatgtactattttacttaactccttcaacagctcagaggtgggcagtcagggtggtgaaaataatggccatttaacaaaatgtgtctggaccctttaggtctgtgtgggatcatcagtggtgaggcaggatagggtttgttcttgagttattttgggtctgagactttggccagtgataactgaatgttccatagagtagtttttcactttggaactccttaggagtcacatttataccctctgaagggtcttagctagttctgtaatgtgtattacattggttaccttgatctctctccgtctatactggcccctcctattcaaggtgttcaaggttctgttgtaaccttagtaacctataataagtattcctaatagtcatcagtatcaccactgttaacacatttgggcagcaccatgcatggcaggtcagcaaacaggtaaatcttatttttttaaacattacacataatatctaaagtatagtatgtggcatgtaataagtgctgctgaataaatggaagtcattgttcagtttttagcttaatatatctttttttttcttttaacataacatttactgaatgttgctaagtataaggagtaagggacataaaatgaatgagacttggtctctgcccttgagaaactcacagtcgagttaaggactgtgaaatcatgtttaaagttccttagccttttcctttgtgtcatcatttcttcccctgcactgtctatgcatgatatagcctgtccattgtttctcacagctttcctaattctgtgtgcctccccagcctttgagactgctgatatgtgagaaagccaacaattgtcttctattaatacagggtaatatcaagaaaaacctttgggccaatattggatttcagagtggcatgtgcagttgacattacaataccagtttatggtctttagatgggcctgtacacctgggctccagcctctttcctgtgcctttaaactgccttacttccatctttcctcccctataccctacccttaatgtacttggtacataaaaatagaggctcccatacccaggtagtgatcaagtacaatgtaaagaaacagctgtacttcatataaactaggattcgagtgggcctagggtatatcactaaatttccattcttatctataaaacagtaatcggaaagcctatttcataggttgctgtgagcattaaagcgagatgatgtatttttaaatgcttgtaaagtacgaagataaggtcattataatttatataaaatacttagtagctatgttacttggggcaaattacctcatcactgagccagtttcctcatcctttaaatgaagatggtgatattcatttaacaaatatttattgaggacgtagtcattgcagctacatcctgggaatacaaagataagtgactggagaatgtaggacagtgtggtctaggggaaggagacttgcaaatcacacaaaagggtcagtatggtaatatgaggaatgaacaaaatgtgctatagcagtttacaagaaggcatcagagaatgtcacagagttttgttagggttaagcaagataaatgaaaagtacttcatgaattcaaaaatgctatacaaataagttagttaaacgtaccccaaatgaatcaatagtctcaaaccattattgtttcatttcttcacaagacttactctttagatgcatttatttctttgagctagattttatgacctccttaagggtaacctgtagtagagtatcctgaaagttaatgcttttgtctaaaaggatttttttcatccattttatcattttctagtttttaatcactgaattcaggaaaaactagaaaatgtgtgcatatttggggagaggatatacataattccaccacaatgtttagtcactgttaacattttggtgtattcacatcttaatgataagggtagtgtttaaggaataagaaaagaaatctagtaggaaattttaaggataggcatttcccagaataggaaactaaaaacgtccactaacaagaaatggtactcaaactaataatcagaaatgcaaatttaaataaggtcatttttagtcattagattgataaaaaataatttgataatatcaagtcatcgtaaaaggtataaggaagagtctggccttataatactgcctacaagtggcgtaaattgatacagctattttggaggcaattttggcaagttgcaagagagtacatactatgtgatgctatttatgttttaaaaaaaaccatggcaaactgacaactttatttgggaggagggatcatggggaactttacctttttctgtaatatgtgcatttctacttctgaaaaatatactgagaagtacagagaataatacaacaatccctgtccctacccccactccagaattgatcatttttaacatttatttttgccttacatttttttgtggagttggaagtaacacaagttgagtgtccctaatccaaaattcaaaatgccccaaaatgagtttcaacacgatgccacaagtggaaaattctacgcctaagtacttaacactttgtttcatgagcagaattattaaaaatattgtatagggtacaacgaacattatttgggtgatggttacactaaatgtctagacttcactactgcacaatatacccatgtaacagaactgtacttgtgccacctaaatttatacgagaaattgtgtaaaattaccttcaggctgtatgtataaggtgtgtatggaacatgaatggatttcatgtttaaacttgagccgcatcctcaagatgtctcatgatgtataggcagatattcaagaatctgaaatctgaaatcctgctggtcccaagcactggataggagatacttaacctgtataggtaaacaggagatacttttttaatacccagcattcccttccccccttacaatcagtacaatgaattgcttgaatttttctactgtgagaatggtataaattatgaatgtaagtaaaagttcaaaaccgatgtggtggccacacaaaaacctattattaaataatattaaatttgtacagtattttagagtttgtaagaagcattctgattttagtaagaatgctttgggaatagaactttttttcgtttgctcattttcttgttaactcttgtttgaaaacgttttcctgaatttgtttttaagtaatcttcatgactgtagaattatacatggcttattgttgaaaaatacagataaacagacaaatttccgcaaaccccaaactcacagataaaatactcttaacattttggtatgcagtatcttcttcgaaggcttttcttaactgctctgtagccatattatatattttttcagaaatgctctttttaaaatgtaattcattacctcccttccagctttcaattttgtatgaaaaatttcaaacaaaaatgctgaaaacatagcacaatgaacatctgtataccatcagctggatccaacaattaagtatttgccatattagatttatatgtacagatgtgtgtttaatttttctcaacattagaagtaaggatgacactttatccttaaatctttcagctgcatgtcttaagaatgaggacatctcagccgggcgcagtggctcacacctgtaatctgagcactttgggaggccaaggtgggtggatcatttgaggtcaggagttcgagaccagcctggccaacatggtgaaaccctgcctctactaaaaataaaaaaattagctgggtgtggtggcacctgtagtcccagctactcgggaggctgaggcaggagaatcacttgaacccaggaggcggaggttgcagtgagctgagatcacgccactgcattccagcctgggcgacagagtgagactctgtctcaaaaaaaaaaaaaaaagtaaggacatctacaaaaccacaataccattatcacgcctagggagtttattttttcttaatattatctaatatccggttcatattcacattttctcagttgtccccaaactgtctttttttccaagctgttttctccaaactagtgtagaaatggtatttttaactttgctcttcccacatattgacccctgtttcatgtctttgtcattatgtatacttctgtagcatttttaatggctacattgtattctattgtatgcagaatttatttaaccagtttgctttgttcacaccttttgctgtgttcatacttttccctcaggtgtccccaaactgtcttttttcaagctgttttctccaaactagtatagaaatggtattgttaaatttgctcttcccacgtattgacccgttccatgtctctgtcattatgtatacttctgtagctttttttttttttttttttttttttgagacggagtctcgctgtcgcccaggtcggagtgcagtggcgcgatctcggctcactgcaggctccgccccccggggttcacgccattctcctgcctcagccttttgagtagctgggactacaggtgcctgccacctcgcccggctaatttttttttgtatttttagtagagacggggtttcaccgtgttagccaggatggtctcgatctcctgacctcgtgatccgcccgcctcggcctcccaaagtactgggattacaggcgtgagccactgtgcccagcttctgtagcatttttaatggctacattgtattttattgtatgcagaatttatttaaccagtttgctgtgttcacacttttccagtcccagtttctcatgattttaagtaatgcctcctaacatacaggtaattcagcattcagtaaataagtgtcgaatgaaagaagcataggtacatcctaatagataaatatttatgagatccatatttaatatttttaattttttatttccataggtttttggggaacaggtgatatttggttacatgagtaagttccttagtggtgatttgtgagattttggtgcacccatcactggagcagtatacactgaacccaatttatagtcttttatccctcacccctttcccatcctttccccctgagtccccaaagtccattgcgtgacatccatatttatatccttaagaaatttctacaaccggaatgtaaaaatgtaaggcttttaatactcattgctaaattggcctttagaaaggctaaccttgcatttttcactgtgatatgtttagtatatgatccatcatgatttacaatattgtagcacatcaggataagccttgataaatcagaagagtataaatctggatatagccagtatcgttgtagatggctcactgcatatatacacgtatatacatatacgtacgtacacgtatatacatagacatatacatatctgctgccatatttttccaggggctagtttgactcttctactttggagggctttgcagtttgttaacccaatctggagtccaggccccggcttcttacatttctttaaatatcttggtgagaccagccttaaaaggaagtatagtctggagagatgcagacatcactagaagatatccttttacgtagagaattttagatttttgcttttaaaaagtaaagacaggctgcttttatgggtgaattcagatctctccctctagcaaattaccaacagctttaaaagggtagtcttcatgtccaacagaaaagctggatgataccctatatttcctattatccatatcaaactccttattttataggcccagttgtaggagtaataacatatccatggtaacatggctggatagtggtgaaattgagcatcaaacccaggttacctagtccagtattgttttcactatgttttatctctccttaaaactgaactttatttctaaatgtgccatctggtgtcatctgtagaaatacaaagtaagtggtcctcttcctatgagaaagttactccccaaataggggaattttaaagtagaaagtcaacgtgagaaaggcaaaaatccaaagaaagctcagtttctttgcccttttaaccgtagttactactttctgacatgagatcaacttggagctctttcatggaacagttcgatttggccatgtgttttcatgcatttatggatgctataaatcagtagatgagactgaatttcctgcttgtaaaactttttcaaattaaagggctgctttctaagtccatcttattttcccttccttttttcaactgttttaaactataacatgtttgctatttttaaaaagattgaaacaaaataatagtttacaccttttagcattatagttaagtattactgtgttaagtatatacttatgttaagtatttttatactatgttaagctttttatgctgaagtaatggtgtgaagtaggtgtgtacttttattttcatccaaatggttagccagtagctcctgtttttcttcctggcaaagtctatttgatctttaaaaatattcttagcttaaaagtgaattatttgcagaagtgtagttttattttttaaaaacctaggaatttgtggcaagtagaaaactagcatggttacttttagctgtttagtttttgaaaataattcagattgttcatgtttaatatttaacatttgtcttagactgaaggcaaagtactacagatagtgctttaagggatcttagttattgtacttccattttacatcatgttggaagcccagaatgtcataaggtcttaaagccagttggtggctgagaactagagtacctttgcatacttcactttcatttctagcaagcatctttcatgtaatagatatgttttaaagcagtagattgttcagaattgtctggtttatttaagaacatttgaaataactatgtgtcaggctgtgtggagcaccataaaatttactcagacagccatttttttctatatgttgggacacctttgtttttaaaggctttgttttacaactttcttatcagtgaactaatttgagcctcataacaaacctgtgaagttggaattcttttcaacatcctggaaagagtttgctgccaggttgataattgctataaataacttgctcttttaaaccatgcaaaagaatctttgtctccattccttccaaattcatttgaaccagctcaaaacagttgagacccagttaaaatttttgattaagtggcatggcctgcacattatttagtagactgtttaccttttgcagaactgtataatttgagaatgaaactggagcctcccaatctcattgtcatcaaagtagagtttaagttgttggttgtctgcagttatggctaacagtatggagattagtatatactgtatgttctccttcatatgcaggtaatgtgtagaaagattgagaaggccagctcttttgcatatgatcagatttatatatctgtatttctgtcttatcaatctgtagaatacctagcataaggtttctgcctttagattaatctggagccaaaagaaatagaacaaatagcaatacggcttactctttgctgggcacaatcctatgagatagacttgtttattttacagaggtgactggactcagagatgtatggcaacttgtctaagatcacacacctagtaaatggaatttaggcccagatctgtctgtttcccaggcttttccattatgctgttgtcctttacttcatttttacttttcttccagtggtagtcttcagcctctacttttttttttttttttttgagatggagtcttactttgtcactcaggctggagggcagtggcatgatctcgactcactgcaacctccacctcccgagttcaagcgattcttctgcctcggcctcccgagtagctgggactacaggtgtgtgccaccacgcccagctaatttttgtatttttagtagagacggggtttcaccatgttggccaggctggtcttgaactcctgatgtcatgatccacccacctcagcctcccaaagtgctaggattataggggtgagccaccgcgcccggccggggaggtttgatctttagagatgctgcttgtttctctgcaaacccaaggacatgagagaattggagctgaataatgcaaaaggggtggaattctgtttctttggtatctggtaccatctttattgtatttgacagtagtctatcatgtggctttgggaaaaaaataccatatacctgtgtttcataaatgaaagggaaatacaagggaaaacattgtcatggctagatagacagtgtcttaactttctttagggcattggttcctaatgttcttcaggtcatagatccttttaagaagccaatgaaagctgttgaccgtcttctgggaaaaagaccaacatatgtaaaatttcccacagaatttcagggtttttgtagtggtcatccttcagtataggatgaggaattctaaagattcctctacacttgtttttctctatatgtcattaagatgtctaaattgctatgttgtttgttcttgtatttcttagtacaggcgtccccgacttaatgatggttcaacttaggattttttgactttacgatggtgtgaaagcgaaacacatttagtagaaagcatacttgagtacccacataaccattttgttttccactttcagtcgatattaagttacatgagacattgaacatttattataaaacgggctttgtgttagatgattttgcccaactataggctctaatgtaaatattgcaagcatgtttaaggtaggctaggctatgatgtttggtcggttgggtacagtaagtgcatttttgacttagatatttccagtttacaatgggtttactgggatataatcccatcatatgttgaagagcaactgtatatatttttctagacttatttttctacacagtggtcaagggtaagcttggctaactgtgtcacttttgcttaaagatatactctgtattatgcaaatttaatttatcttctgtattgatcttataattggttgtgttttcagcctttgggcatgaggaagttgtaattctctttttttgtgtattgacttcgttgcctttatattacgattgcttctaatctattttatttctgatttttttccttattttctacatttctgtacacctggctatctgagtattcatctcaatgccctgcatatagtatgtttataattgttgaatggaaagatgaaggttaaatgaatctaaattgtttttttcagttcaccaagagtttaatgtgacttggattttttttagttttgttaagcatttactggatagttattcatttattaatctgctattaataaatgacagttcatatgctggtacaggaatgcaaagataaatatgatacagtcccactcttgcagaactcagcaagcatagtggggagactgtcaggtaagtaaagaggtgtgctgattgaggatcaatatgcaggatatagttggggctaaataaagcatgtggggagctgagggaaatattatgtaatatcatagcactggtaagagaggtaagcagggaccaggtcctagaggtcttggatgctggtttaaataaggagtttgtacttgatgtaggtaggttttgagttttagggagattgctctggcaacaatgtggaggatagaatggatggatccagcaggaaaaagtctcactttaaaataacttcaatttatgagacttttcaaaacatatacaaaaatagaaaaaagcataatgaacacccatgtaactgtcacccagcttgaacagtgatcaacacagggctattgttctatttataccccgctcctcccctctatttttattaaagcaagttcctaagtcacagaatggcaaagcatatattgaataataatctaatgccatggctctcaaggctggcctgtgctgccaaatcacctgtacagcttgaaaaaaataatccccacttcagacctactgaattagatagctttgaaatgcctgtgtggtcaggcatttttagttttcaaaataagtctcgggtgaagtaagttatttttaagataattttaaaataacttctgacaaatgaaaatactttcctgaactcattgaatgctgcctgtggcccttctgggtgaaattcacctattcgatacaggcaggcttttcttataaatttttatttattttttgtagagacggaggtctcactctgtggcccaggctggtctcgggaaaactcctggcctcaagtgatcctcccacctcaggcttatcctcccacctcaggcttccaaagtgctgggattacaggcatgcagccagaaactgacaattcttaaggtgtagactaggaatattccagagtaccaatttaaaatgtgtagacaaggagtctgttcctctcctgcttaatttgcttaacttacacttaggcattgctgtttttattttttgttgagaataccaagaagggctccttagcatgctgtcatttcctctgtattggtaaaattgataatctgcaactttggtgagccatgtttggttgcctagttcttctgatgccagtttctctaagtaattgggagtatccgggaaggataactcccagatctgcagcttccccagactgtttgaatagaggatgtggcaggagatgtgttctcagatactattctcacgttcaaagtcaacattggaggtttcagattcctctttcttagtatccctccctgcccatattttccttgcttaagcataactgcagtgcagagaaacacccagagccagcataaactcttaatctgaggtatagtgtgttttcagattttaaatgagagactccttcaaggtatttctgcaaataatttccagatttgtcttgggtgagtaaaggctatttttcagttgctttattatgacactttactgtcagtgcccagtaaaacctaggtcagcagttctcagggcacttgagagtcatgttttatgtggctaaggatagggagactggtgtctgtaggagaggggcgtagcaaggtgggctgtgcatatagacattatgtgcaatgtagagttgtggaacagatttgggtttgaatccacgttttaccacttaataggtatgtggccactctcagtaaactgggcacagtcttcatctccaaggattaaagataatgcacaataggtatagagtaagtgttagctatttttttatgatcataaatgtttttcacaatatttgttgagtggatattaatgtattaatagataatcagaaactagataggatggaaaggcctgacaattatgtggtgtcccctttaacaaatcataatcagtgacacctattcctctataatcaaatagtgaatagcaggctggatttcaagatgcatcttactgcttgttgacatgaagaatgctcagggcagctctcacctgaatttactttcagagactataaggcaaaaggaaatcgttgcaaggcaaaaaataaagtattttgctttgtggtactttggagtttagttttctctaagcattttttgtttaagaactgccgtaatgcttccatgatttctatggggattttaggctcattttgattcatccccactcccgtacttacgtgcaacatctcttacctgctaataatcaaccaaagtgcctcctgtgtgccaagctccaaacaccagaagatgtagggaagaagctcctagagtaggcagcagctaatctaaggcatttgtttagatggtgttcttaatctggtgcatgtcctttggctcaggggccagtgttttcttccttaaggaaaattttaggcctggcacagtggctaacgcctgtaatctcagcactttgggaggctgaggccaggaggattgttttaactcaggacttcgagaccaccctggacaacatggcgaaaaccctgtctgtacaagaaatataaaaattagccaggcgtggtagagtgtgcctgtggtcccagctactctggaggctgaggtgagaggattgcttgagcctgggaggttgaggctgcagtgagccaagatcatgccgctgcactccagcctaggtgacagaatgagaccctgtttctttaaaaaaacaaattacaaaaggaaatctgattataaatggatccatgatttataggaaatttggaaggattagaaaagcatgaagcataaataaaactatgtgttaccctgccagctagaggcaaccattaaaggccaactactaataatgtgtatttcttcccttcccaggtttttttttttttttaactttcccaccctgtggcagacattttctcataaatagggaagtgataggtacagagtacaatgtaatcacatatggtgggatatccagtcaagatttgaggggttcgggagaagattgtccaaattctggatatcattctgttcaaacctgcataagtgcttattatattacagtgaaatagaggctaaatggtcccctacccccaattttcaaagggattcttacagttactccgtcttttcaagacagtttgcagccacttgagaacataagctagtgtctttatttaccttttcctctacatttcagtgaccccataattctctgcttccatttacagcctatatatatattttttcccccgagatggagtttcactcttgttgcccagactggagtgcaatggtgcaatctcggctcactgcaacctccgcctcccgggtttaagcgattctcctgcctcagcctccgaagtagctgggattacagacatgcgccaccacacccggctaatttttttgtatttagtagagacggggtttcaccatgttggtcaggctggtctcaaactcctgaccttgggtgatccacccgcctcggcctcccagagtgctgggattacaggcgtgagctactgcccctggcccaacattttcagaagaggtttttacacataccatttatgctttctcactttccattgattccctgactctagtctggcttccattccctccatcccactgaaacaattgcttgtcaaattgtctctattaccaatttcagtggacatacctcattttgacatttgatgcagttgatcactcttgccatctttcgtctctcgtgatagcataattagctagttttgctctttcctcactagcctctccattgctgggttttccttctttccttacctttacacttttattgtattgtattttttttggtagagatggggtttcaccatgttgcccaggctggtctcgtttaaggaatctgccctcagcctcccaaagtgctaagattataggcttgagccattgtacccggccccttctttgccttacctttaaatgctagagcaaataactcagttgcgggcctcctcctttccttctttgtaagcagtcatctccagacccatggcttcaagtaatatatgtgtgctgacaatcacagattttattcttaatgcatacgtctttcctgaactccattctacaaatatttgcatacctatcatgtggaagataccgtgctaggtactgagagcttaacatcttagaaaatcaaaccagtaattacagttgatacttgttatgaaggaaattggaaataaactgggtgctataatagaaaaattacagtgggaccaacttgaggtgggttgtcatggaaagcctctctgggtcttagtttaaatgtcagttcctcaaatggaactagttgtgggaaaggaggggtggcaaaaacattccagcggcgaacttagaaattagagtgttccaagaactaaatggaaagaataattacacagttgaggaaacaagcatagagaggtggatttgtctgcggttatgcagtgagtaagtgatatagcagggattctagcccaggttttctgagtctgtattctgatctagtgcttctcaaactttgttatatggatcacctaaggatcttgttaaaatgcgggttctgactcctcatatctaggtggggcctgaaattctgcaacttttaataactcccaggtgatgtcagtgctgctgatccttggaccacacttgattagtaaggctagtctttcactacatccaactgctcttgagccagatttgggaactacaggtgtcctgtgcccttaaactgattcagtattgaaagtcattatttttaaatattatcaactggaggtgattactatagaatatgagtcacgctttgagtggcttccctcaggatattttagttgtgtacacttgttctgcaggtaaactgtacaaaaccaagattcaaacctcaggggtgtaaggaaaggttgggggaataaggaagtgaaaaaaaatattagataaaagtattgaagtaatggtaatagatatggatggtgattcatagtaattcacttgttttcttttaagttggctatctttctaacctaagtttaggaagcaatgtttattatatatagagattgcttggtgccctgagttctggttctgacccaacaaaggcagtaggccatttctaggaatttgtttcaaactaacttatttttatggaaggatttttttttaaatgtaatagggttttcacctgattaacttctaagaggtagaactcattccccagttactgttcctttcattagtgaaattacagcatctcagcttctcatcttgggccctagtttcctctcttggagtaattttttcaaacaaataggattcagcagtctagaagaatctgtcacaaatttttattcttatctgccaatattttgtagtaataaaactggttttaaaaaaaggtgaggctgggtgccgtggctcacgcctgtaatcccagcactttgggaagccgaggcgggcggatcacaacgtcaggagatcgagaccatcctggctaacacagtgaaactctgtctctactaaaaatacaaaaaattagctgggtgtggtggcgggcgcctgtagtcccagctactcgggaggctgaggcaggagaatggcgtgaacccgggaggcggagcttgcagtgagccgagattgcgccactgcactccagcctgggcgacagagcaagactccatctcaaaaaaaaaaaaaaaaaagtgaatcgcatgttattaaagcatggacttggtagtcagacctggatttagatcttggtgctaacatttactgaccaagaaaggtactttttttctctcttacttcagttttctatctgtaaatagaggcaaaacttgacttgagtggtgaggactgtatgaaaaaatatcatatgaattccctaggtagcatgtctcaaactgtattctttggaatacttcaattggactttgagtagatgccacttgagaaaatggttctgtgcgctaataagcctcctttacctaagatgtcttagagccattaataatgtcaattagctatgtgactgccctagtggaagagaaattctgtctataacatttcccaaattacaggattcttgtctccctttatagagcaagacattctaacacactttggggaactccagtctcagtattgtctggcttgtaatggacactcagtatactaacgttcccccctcccactgttgaaaccagttttagaaatatgagaacacaacaacttctaaatttttaaagttgatgtctcatggacagtgatgtcttggttttttaaactacaaatgtttcttgcagtagaattatagacaccaaggtaggactgcacttgttatgggaacatttgtgtgtgtgcattcatattggctctgttattttattgggtgcatcaaatgcttacacttgggacttagagtctagcgccactcatgcaaataacctgagatgatttagaattatgccaccagcatagtttctaggcatccagagtcttgtgttggcagcagaagtaccccaagctaagctgtttccgtggggggtctggctgtagttccaggctccctagcttccttggttcctcttagttttctgcacgtggagctctagccttctgtcagttctgtgagctatcagatactctccagtaaattacttggctgcattaattatccagtctttctgtagttacagacacttgactagtatagtacactaggtcaaaacagcattagagcaagttgcttatttgtttgaagattcatcagtgactcatctgcattaaaaaagtaaaatggttgtgatttgcttatttcagtgcataagttactctgtgctcttgttttggaggattgtttttttaaaatagactttatttttagagtagttttacattcccagcaaaatcgagcagaaggtacagaaatttcccatatactgcctgcctccacacaggcatagcctcccttgttatcaacatctcccactagagtggtacacttgttacaattgattaatctacattgatacatcattatcactcaaaggccatagttaacattagggtttactcatggtgtatacttttggggtttagacacataataacatgtgtccaccattgtagtatcatacagagtagtttcactggccaaaaaatcctctgcgctccacctcttcattcttccctccccactaaccctcctcaaccactgatctttttactgtctctatagttttttcttttctagaatgtcatgtggttggaatcatacagtatgtagcctttttgtactgatttctttcacttactaatatgcatttaggtttcctccatgtttgttcatggcttgatagctcgtttctttttagtactgaataatactccattgtctggatgtaccacagtttatccattcacctaccaaaggacattgtggtttcttccaagttttgacaatagtgaatgaaggtactataaacatccatgtgcaggtttttgtgtggacataagttttcaactcctttgggtaaataccagggagtattgattgctgggtcatgtggtaagagtagttttgtaagaaattgctgaactgacttccaaagtggctgtactattttgcattcccaccagcaatgaatgaatgttccacttgctccacatcctcacaagcatttggtgttgtcagtgttctgggttttggccgtagtgatatatcatcatggttttaatttgcatttccatgatgccgtatgatgtggagtatcttttcatatgtttatttgccatctgtctgtctgtggtgaggtgtatgttaaggtctttggcccattggcccatttttaaatcagcttgttttcttactgttgagttttaagagttctttgtgtatcttgggtaacagtcctttgtatgtcttttgcaaatattttctgtcagtctggcttgtccacttattcttttgacagtgtcttttacagagcagaatattttacatttaggtctgtgatccattttgacttaatttttgtgaaacatgtaatttcggtttagattttttttttcgcatgtatgtatcgagttgttccagcaccatttgttgaaaaaactatcttttgtccattatattgactttgcttctttgtcaaagatcatcggttgacaatatttatgtgggtctacttctgggctccctaattctgttccattgatttgttcattcttttaccggtacagtactcttacttactgttgtcttatgataagacttgattttgggtaatgtaggtcttctgactttgttcttctcctttgatattgtgttggctatcgtggatcttttgcctcttcatataaattttagaatcagtttgtcagtattcatataacttgttgaaattttaattggagttgcattgaatctgtggagttggaaatgacttaacattttggcagtattgaatcttcctatccatggacttggaatatctctccatttaattgttctttgatttctttcatcagaattttatagtcttccttgtatagaccttatacatattttgttagatttatatctaagtttttcagttttggggtgctaatataaatgttttttatttcaaattctgcttgttcgttgctggtatataggaaagcaattgactttttttttttttttttttttttgagacggagtcttgctttgtcgccccaggctggagtgcagtggcgccatctcagctcactgcaagctcagcctcccaggctcatgccattctcctgcctcagcctcccgagtagttgggactacaggcgcccgccaccacgcctggctaattttttgtgtttttagtagagacggggtttcaccgtgttagccaggatggtctcgatctcctgaccttgtgatccgcccgcctcagcctcccaaagtgctgggattgcagacctgagccaccgtgcctggccagcaattgacttttgtatattaaccttatatcctgcaaacttggtgcaattgcttgttagttccagggtgtttttccttatttcagattttctgcatgtatgatcatgtcatctctgacaaaaagacagttctgtatcttccttcccaatctttataatttttatttcctttactgctttagctaggactttcaatacagtgttggaaagcagtggtaagagaggacatctttttcttttttgagacggagtctcactctgtcgcccaggctggaatgcagtggcgcgatctcagctcactgcgatctctgcctcctggattcaagcaattctcctgcctcagcctcctgagtagctgggattaaggggttttgccatgttggccaggctggtcttgaactccttacctcaaatgatctgcccacctaggcctcccaaagtgttgggattacaggcatgagccactgcgcctggccttttttgtttgtgattatttaagggggaatgctcctagttcctgaccattaagatattagttgtagctttttttgtagatattttaatcaatttgaagaagttctctattcctagtttactgagattgtttgacttttcactgttgaattttgagagttctttatgtattttagatactatatatggtttgcaaatattttctcctagtaaattttattgtcctatatttaagtgattcattttgagttaattttttatataaagtgtgaggcttaggtcgaagttcatcttttttgcctgtgcatgtctgctttctctggcaccatttgttgataaaactatctttccttgactgaattgtttttttttttaacctttgtcaaaaatcagttgggcatatttgtatgagtctatttctgggttctctattctgctctattgatacttgtatatatatcagtactacttgatgtctgtagctatatagtaagtcttaaaagtgggtagggtaattcaattcctccctcttttatttttttccaaaattgtttcagccattgttgttcttatacaacatatacactttagaataatctcagcttatttacaaaaaaacatcttgctgggatttgaataggaattatattaaacctatataacaattttaggagatttgacatctttactagagtcttagatctctccatgtatttagagctttgatttttttttttttttttttttttttgagactggagtctcgctctgtcacccaggctggagtgcagtggcactatctcggctcactgcaagctctgcctcccgggttcatgccattctcctgcctcagcctcctgagtagctgggactacaggtgctcgccaccacgcctggctaatttatttttttttattttgagatggagtctcgctctgtcgccaggctggagtgcaacggtacaatctaggctcactgcaacctccgcctcctagtttcaagcaattcttctgcctcagcctcccaagtagctgggattacaggcttgtccttccacgcccggctactttttttgtatttttagtagagacggggttttaccgtgttagccaggatggtctccatctcctgacctcatgatccgcccgcctcagcctcccaaagtgctgggattacaggtgtgagccactgcgcctgcctggcctttgtttttttaagatggagtctcgctctgttgcccaggctggagtgcagtgagccactgcgcccatcctctgggaggcttttaaaatagatttcttgggttttctatgtggatgatcctttgacatctgcaaatagggaccatttttattttttcttttcttatctgtgtgcctgttatttctttttcttactgtattatattggctagaactttcagcagtatgttgaataaaagtcatgataacagacatctttgccttgttcctaatcttagagggaaagcatcagttatttgagttgtattgaggctggctgctacgtcttgcagcaggggcagtttaatagcctccctgcaaatgactgaagcgacaatagtgtgacagccacttgcgtaagacgtttatgagaaaaggggaggaaaaaagccttgagagtaagcgtacaaatagctcagcttatagtttccaccacatggacaggattgttgccagaatcctgttggcttcatttgagatattttgaggttgttggcatcaggcattttgttcattttgtattgatactgagataactttttaaaaagtaatctggaattacacaccctaaatatcaaccatagaaaacattttttcttcttaaggaatggtctctgcagaaatgttttagaacgtattctgaatttttcacaaactcttccttgaatgcctgctgattgaatggatacaggtcgtacaggcaaatacacgctatttccatagtactgagtatattggactaaatctaggcaaaaagctgcctaaaatttatactgtaattggtcagctttatattatggcagccttctcgggggaggaacattgatttctagtgactgccactgagttaaatacattgttaatagcagaatcttttgtgtgtaaagagcctgcaacccacttctacctctgtgcatgtgtcttagttgctaacaggagaaacttatttcttcttgtgctttggaggacttgtctgccatcaaagatctagggattatacagtggatctgatcaggctgttgtctgcttttgagccttccaaattacatggcttaataaaatgattgttttctgtgctcagaatatttctgttgtgatccttatacttcattttctagttgaaaaaagtgttgttttgcctttgctcttatgatacaactaatacatttttattggtaggaacagtaaaaggtgcataggtaaaacagtcatacttaatccttttggttaacaatgaattaatattctgatgcctagcacctctaagctgttttctttagacataagttttataccgtatgttctgtgttgtaatctttttatttcatcatgaacatctttgtgtattacatagtttgcaatatttttaacagttgtgtgacattccattttaaaccagtcgtattttggacatttgatcttttttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttattttcaattaagagtttgagatgcttgtaaaagagaaaaaattttcattttgacctgatttggtttcagtcttgtgcaacatagggatgtgggccagtttgatctggagagattctttacctctctctacctgatagctgtgcctctgagttggcatagcatcataactccagtgtttttactttaagcattttgcattgctcttcattctgtattgtctgtgtccaagcttgtagagctcaagattgtagctttaagttctcacttcttttgggattttcttttttcagatcgtaaagctgaaaattgaaatcatgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctagaaacagtaagattttcttttgaacttccctggatcaaaaaaatggatagccaagagaccagtggaaagtgaacaccgatcagttagttcttcgtagctgtgtgtgcctgaagtcagctctcaggctgctgtgcaattccttcctatgcagaaaggatgtgtggtataatggaaagagcagatatgggttcagatttttaatgtacttctgggatcttgcaattttgttttttagaaaatgaaagtggtaacatctttcttactagtttttttgttaaggccagtgttttagcttgtctttattactgattcttaatcacacaattcagcttaacttgtgtattgggtggtcatatcaattaaccctttgtcgacagtagaaatcccagctttaatctagtaatattccaccagctagcttgaactgctttctaaggttgaggaagtggtattgcattgtgatagtcctgttgaccccttgtgcttagttcagagagcacaagctttgaaattagacctaggtttgaatcttaccagacttttgtggctgagaggttattaacttgcctggtttccacagctgcaaaatggggctgaaaattttttccttcttgatgtgaggcaattgcttagcatagtatctggcacataagttagttcatatcgtaaatacaagccacttggttttcaaaaaatgtaaaagtacctggcaagtatcaccaaaagataacaataacattttgctgcatttcttccagttttttttgtttgtttgtttgttttgagacagggttttgctctgtcacacaggctggagtgcagtggcacgatcacagctcactgcagccttgacctcccagctcaagcgatgctcccacctcagcttcctgagtagctgggaccataggtgcatgccaccatgcctggctaattttttattttgtgtagagacaggatcttgccttgttgcccaggcttcttccagtcttttaaaaaattattacatgtgcacacacaattatcctgcccttttcatttagcattgtactaatgagtatgagcagcactttcttcatatacccttgtcagtattacagattgtcttttaaatttttgttaatttcataagtggggaagaaagtatttcactgttctatatcagttatcttcttgtgccattcattttgtatctgacattggaatatcagtgtttctcttactgaatgccatatatattgaacgtactcattttcatatctgttggaaatatcttcatttgcttttgattttgtttttgatgtgttttggcatctagaagttttgacaactgtgtacttgaatgtcttttactgaaggacaaaaagaaaacttgcttaagaaactataatttaaaaatttaaagtggaaccaatgtaagaatctactgctacgagaatagaagacctagaaaagtgatcctagtgtatataagaactagatatatggtaatagagggattataaattggaaagaagggacagtattaggaaaccatgctagaatgattatcttgtagagcatgtgggactattatattgcgataaattttagataaaccaaaagtcaaatgtttttaaaagaaataagctataggagaagtagaacatgtaggtgaatgtttactttgtcttaagtgggcatggtctttccaagcattaaaacaaaggaaaaaaaccataatggaaatgttaaatactgtatccaaaattaaaaagacatgacaatagccatcctaataggtgtgaagtaatatctcattgtggttttgatttgcattcccttgatttccttgatagggagcacctttttatatattttaaaactatttgtatgtaaatagacatctggataaatgtctattcaagacccttgcccgtttttaaattgtgttatttgggatttttttgctattgagttgcaggagttccttatatattttggaaattaatccctggaagacattaggcaaagtgaaataagtcagccgcagagggacaaatagtgcatgaatcctcttatatgaggcatctaaaatagtcaaaggtgtaaaggtaggcagtagaatgatagttaccaggaaatggtgggagagagaagggggagttgctgctcagtgggtataaaattataccaggcaagttcgttccagagatctgctgtagaacaacatagtgcctatagttaacagtcaggtattgagtatagtctgccctccgtgtgtgggttccacatttgcagatggaaccaactggatagtaaatatttgggggaaaaaacaataaaaaagaacaatacaaaagtaaaaatagaaattttgaagcaatgcagtgtaacagctatttacatcgaattcagtattgtaatactagagatggtttaaagtatataggaggatgtgtataggttatatacaaataccattgccattttatacaaaggatgagcagcatagattttggtattcatgggggtcctagaatcaatccccagtggatacagagggactactctacttaaaaatttgttacgagggtagatctcacgttaagtattcttaccacacacaatcatgcacacacacgtagggacacaaggaaacttggaggtgatggatatgtttattacctggattgtggtgatggcaacgtgagtgtatacatacatccaaactcacccagttgtatgcatgaattacgtgcagtttttttgtataccatttaccccttaataagctcaggtggggtgggggagggggaagacacatgacaagctggggaaaatatttgtaacccagtgtagttaatattttcagtagctaaatcaggagaaatgaatatcccaatgacaaaatgggcatagggcatttaagaaaagaacaaacccagtaaacgtccagcaagattcaacttagcgggtaattggagaaatgcaaattaaaaaacaatttttaacctagtggattgtaaggggttgctcttggagtcatatactgatttctggctcttatttcctagttactagcaagttacttagcataaactcctagaagtggaatttttatgtcactggttatggacatttttaagacttgagttgtctattttccttgagcagcatacatgattgcccccatttcccatactgtggtcaatgctaggtactattatgaaaggcttttattgatcactttgtgtatcagtagctgtgcaaaggattttttccccagatttggtatctattgaaataaatcactgtaaaccctggcaattgttattgagctatcgaactggcaaatgctttcttatatcttaacgttgtgcttgctgctttctcctgcaaaatgcaagggaccttgatagtctgataaaacagagaccatagtactggtacattaaattgatgccattatgctaactggatcttgtgagcagaaaacacaagcacaccttagatgcctcagacatatttgtgccagagagtcagaaacaaaccttgtggaagcttgagggccttttcacattaggaaagtttctagtggccccagggtttgggaaatattgggatatcccttctaaagtgagagggaagttgctgtaccttgtaccacacactgtgaagaaagaggaacaatgtgtgatgcgtttggattttggagccaacatattggttggtcacatttaggcatgctattttgacctatttactggataacctctaacacatttagtggggaaccactaaagtgttagtaaggtttggatctagaaaagactctgcaaaaggtccaggctatgatacaagttgccctatcacttggacattatgacctagtagacccaggtgactgacttaggtgtcagctaaagatgccatgttgtgcttttggcaagccccaatagaattacaagtaagacccctagattcttggctgtgctgtcctctgccaccagctattctacattcacaaaagcagcttctggcttgctactgggccttggtaaagactgaatgcctggttatgggacataccaaattattacaggatccaaatgttcatcatgaactgcatcttacctacacatcgtaaaattggatttgtacagctgcattccattagaaatagaagtaacacgtttgatgctggacccaagtaggtccagcaggcacaagtgaactgcataagcaggtggttcaaatttccatgttatctatttctgctgcttcactgcctctccctcaacttacatcttagaggagaagaggaaaaagtgcaggcctggtttatggaaggattttgtgccaaggattttacatatatttaattaccatgaacatttgaggtagatcttaataatgcttagagggagaaaaggtttggacttagcttaaagaaacccctgttaggttccatgttgtttcagatgccgaaaatacgtttctcccagtttgaatctcacgacagcattgctggatatataggtacatgttagtttattttgcagaagaggatgctgagattcaaagaggtagcttaccaactacctgattccaagggtcatactctttttaatagtatgctgtctctgaatatttaagctcctgtaatgggagataagtattttatgtatgtggcagacgtttgagtttcatatttgtgaggtagctattaggtctgtttttctgataagagagctgtggcttagaggttagacttgctcatgatcaaacagcttagtaaacatgaagttaaaaagtgaatccagacttgtttggttccagacctctggtccattcccaggatgctgtactgcctttatggagttaaagaacaagtgtaataatcacttctcccagctgccattcattaacggaaggcttctctctcccagcccctatccctttccctccttccactttcagaaacttgactataaatgctcaatccactccttgttacctgacaaatggacccattcatcagtagaagagagcagaaatgtatggaaataggaaccccaagaaagaatggagtcctagttttacgaagttcggaagctgtttaccatcttacaagtgaaggattttatgtaacagaaaaatatagctagtgctaatcttcacctttaattgtgaattcactaggacttttcagtctctgattcaatataacctaccaggcattctggttaactttcagaccatggtatagattccttaattgtttttttttttttttttagatgtttaacttattattgtttttgttgtcagcacctttccaaatagtttgtctgcatctacctttatccaaatccaaggtgggtttttgttttgttttttgtttttttttgtttttttttgttttttaagcccaggtggattgttgggggaataaaagcattttctcatgaggtttccattttaatcccaagagattgtctggcacatctcgttttcttaagtagtaaatcctagcaaaaggaaaattgctgtgtgagcttaagggttccttttctgattctccttatttgcaactccctcattccaaaacatcttttgtgaatacttttcttttctcagcctgcagactgcagagccttaatagacaaactcaaagtttgtaatgatgagcaacttctcttggaactgcagcagatcaaaacatggaacattggaaaggtatgtgaagtcaagctcccaaaagacaggactcaccatactaatacatcattttgtatgctctgatatggaataagaaaccacaatgggatagcctcattcagcaattaataagcatctagcatgtgccatgtgcctaacacagctttaaaccagtggcaaggaaaattttgctggctgaggatggagaattgatttcacaggtgatgcttaagaatctcaatcacagaattcctgtggtttgacaatataagtttgagataatttctggatttttagtttagaagaatttttattagataactctaaaaatgaatttttctgataaaatggattctggcaaggatagttctcttgtcttcgtagatcttagaatgtaaccggagttctccatctaaagacctagctctaggggttttatggtgtctattggtgttagcacatatatctagatgggtatgacaatgaactacagcacttttagctcagagtatgatctttctcatatgggcaagggtgggacgtgaacttgtctaggtgtcatgctcagcaatctcttgtaacaaagctcagttagaaagcacccatgcggcgcttctaccttattcttacatcctctttttcctcccctctccagtgcgagttatatcactgggtggacctgttggaccgcttcgatggaatactggcagatgctggacagacagtggagaatatgtcatggatgctcgtatgtgataggccagaaagagagcaactgaaaatgcttc

SEQ ID NO: 5691 - DNA, 36787 bp, human
cgatagtcacacctctcctttgggcctagcagggccagagaaagacggaatcactctacccactcaggttgcccagagagcactttaggttctgactcgcgtggggcgcgaggtaccccgtggggcagctaggtgcctccaagaaaccccgccccagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtggtatctcctcgtgggttcctgtcttgaaggatttcttctccgcctcaactttatgttcaagtagcgctttgggggttgggttggttttcatagcccccacccccggccctctccttttaaagggtgtgtggagttcagaggatgggtggagagcgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcggtaagtgactctgggactaatacccacccactcccacctctttcgtctagattctatccccctcccagtccccctgctccccccacacaccccacttggggtttcagcagtgggggcgggagcggaaggttaagaacactatgtggaatcaaatgaaactcaagggaaaatgactttgctaaagggctgggcaaagaaaggccaagaaggagaggagagagcttggtggaagaagtgaaagggggcaagaatggatggatttgtctagtctagtctcccctggctcggcactcccaatactccttaagcggtaaggattgtctttgacttaaccccacacagccaaagtcacaaccagagagaacaggattcacaaggccaaagctcccaggtaaccccctgaagccatagcgggtacctagagaagcttctgaaaagaaggaggaggggacagtggtttaaggtgcaaagttaggctattggaggcacagagtgaggcctggaagcagctgcgggggaggagctgctttgggcgtgccagctctttaaggaggggctgagcttggttggagaaggaagccagagcctaggctctgctccggccctttaagacgtggccaaggcagttggttcgtctgtgtaggtggaagactgactgggccgagttgctgtgattgctgaagtgaatccatttgtttagccacttggcggagctgtctttttgtgggcttttttttttaaccctaagaatttgggaaaaaataaatcacatccaaacaggtggccaaaggcaccatgtcttatttcttttggtattatattcatcgtgaagaaacgcatttattaagcacctgtcacccagtgtggtaataattgagcaaaaagaataatctttaaatttggatttgaaactgatggagattgccatggtttggggtaatctgctttgaaaccctagtatcaccacttattagctgcatcaccctgggccttgcttttctcttccatagaatgcagattaataattctatctcagtagatactcgggtggatgaaatatcttgtgtatgtggcagaggctgccacttgtatcttagttcaacttcccttttctactcagtttggaactatttttctggaccactgctgataaaattagtgtttttctgtccttaaaacaccttccagatgtggtaaaacgaaacttaggaagactgaattagtttgtccaaaggctgaggctagaacacaggttttatttgcttctgatttaacattgtttccaccagacttcatcacttctgaaagaaagggctactagcctgccttttctctcattctttgggcaacttaaccagaatgatataaccaacaggacttttggacaacagaaacaagtgataggtaaatgacctcatcccattcttcagagttatggggaagcccttgagagttgttgacctttggtgactgctggggacacagagaatgggtggggagcaatgtcttcaggtaagcctggagggcagacaggcagaaaacataggaagagtagaaataataacctcaaaagtaaaaatgacaggtgcatctatgtagtccaccctcaagaccaacttacttaatggctgtaccttcagagccctcaggagctatacatccctcttgtttagacttttcagggcacattggaaattgggaaaaaaataaccatgtagcagactaccatcaccactctcattgttctaatacatgcatttctgaggtggggttctcattggctaagtgaattccaataaccaaagtagcaaacagagcctagtcatttttgatcttgccagattgtctgtgcctggtgcggtgggggcagtatatgatcttctaagatctagctttacaatgccatgattttgtgaatgaaggaaaacttaattaggatgattgacatagatgatcatctagtatgattaccatcttattgttaagtagagtatgaataagggaataacattgtagtattgggctcatttgtttattcaaagacagtgtgagatcatgtttggtattcttcctgatttttttttttttttttgacacggtgtttcgcccttgttgcccaggctggagtgcaatggcgtgatctcggcttgccgcaaccttcgcctcccaggttcaagtgattctcctgcctcagcctcctgagtagctgggattacaggcatgcaccaccatacctggctaattttgtatttttagtggagacggggtttctccatgttggtcaggctggtctcgaactcccaacctcaggtgatccatccacctcagcctcccaaagtgctgggattacaggcatgagccacgtgcccaacctcttcctgatttttatatgctaatgtttactatcctcaactgagtttcatcatttagcctgtttcctcatctctaaaatgacatgataatttgtgattataaataatgtaaggaaagcattgaactcagtgcctgatatctaatatgtttcataagttgcggtctcatcatttttgttatttaaaaaaatttgttttatttaaatgctgctgtgtgtttgcagaagtggaatgtagattagtggacaggaagctggatttaaatatatgaaaggtgctagatgttctgtataatatactaaaagatgttatttgtgtatttagacaaaatagatgtgatgtgggcaaactaagctctaggattattaaggagcaataacctaactcaagagcccaatccagatatttcaaatcactagcaatttgacattttgttgtaacctcacactcaccatttctaatatacagcccatcatcacctctggactcttcactcattcctcattcaagactcttcctttcacttccctggttctgcaacttactatgaccatagtaatggtgaacttatttaaactctgtactttagttgtcatatctgtgcattggggataataatagacactacctcataaggttgctgtgaggaataagtgtgttaattttgtaaacacttagaaggcggcatgaaagtgaagcagtgggaaaatgtagctgttgtggtactcatgtccctttcccctcttcctcattttctcatttaattagatgccaatggctgttgtattttttcccctttgtatctggtatctgtttctttattattattctaactgccaccaccttaatttaggcgagacgtgcaaacaattagcctacagaccaactaaagctcacacgtgttttgttttccctaaaatttaaaaactttcaactaaaacatgcattttcaattggtaatgcattccgcctggctcaaaattcagtatttactaaagggtgcatggtgaaaaaagtctccctcctattcctgttctctagccacccattttgcctcgctggaggcaactaatgttatctatttattaggaatctctccagggatatttagtgtatatcaagcaatgagtatgtttgtgtgtgtgtgtgtgtgtgtgtgtgtgtgtgaataacattgtagtattgggctcatttgtttactcaaagataatgtgaaatcatgtttggttttctatagatagatagatggatatatatatatatatatatatggttcagtatcttctgattattcaaaagaaactggaattctaggaatttaagtgaaatctgattttgaaatactggttatcaatcaacttttaaaagtgtgggactaggcaacttgacatactgacatgaactgaattgtgacccccccatcccccccaaaaaaattcatacattgaagacctaatacctaagcttgtgactgtatttggagatagggcctttaggaaagaaattaaggttagatgagctcatattatatataatacatatataatattagtatatatgtaagtaccacaacaactatattttctcactgcttacttcactttcatgccttcttctaagtgtttacaaaattaacacacttattcttcactgcaaccttatgaggtagtttctattatatatatatgtgtgtgtgtgtgtgtgtttgtgtgtgtgtgtgtatatatatatccccttcaccttttatacacagatagtaacacattctgcatattgttctctacaacttgcttgtctacttaaaaatatactttggagatattttcatatatgcacattttttaaatgcctcattcttttttatgactgcataggtttttactatatgcatgagccacaaatttttaaacagttttctgttgattgatctttaagttatttccaaacttttgcagtgttatttgtaataacaataaaaacttttgtaagcagtgcattagagagctcaggctgccataacaaaataccattgactgagtggcttaaacaacagaaatgtattttctcacagttctggaggctgggagtccatgatcagggtgccaacatggtcagattttcatgaggactctctttctgacctgtagaaggccaccttttcactttgtactcatgtgatctttgtacaaatgggaggagaaagagtgaattctctctggtgtgtcttcttagaaagacactaatcctatcagatcagaacctcacctttatgagctcatttaaccttaatttctttcctaaaggccctatcttcaaatatagtcactaggttaggtcttctacctattaatttttttttggagagtggacacaacacaagtcagttcatagcagtgtgtcaaattgcctagtcccacacttttaaaagttggttgattgccaatatttcaaaatcagatttcccttaaaattctagaattctaggccgggcgcagtggctcatgcctgtaatcccaggactttgggaggccaaagcaggaggatcacctgtcagcagttcgaaaccagcttgaccaacatggtaaaaccccatctatattaaaaatacaaaattagccgggtgtggtggtgcatgcctgtaatcccagctactcaggaacctgagacaggagaatcgattggacctgggaggcggaggttgcagtgagccgagatcacaccattgcactccagcttgggcaacaagagtgaaactccgtctcaaaagaaaacaaaaattcttcaattccagtttcttttgactaatcagaagatactgaaccagcattctctcttggcaataattgcctagagttgatgagcctctccctccctcccctttaaaacagtacttgtattttttgttcaccacattactcatctggcctaggtggccttaacctgtctgacccctagtctagatattgagattatggcacctatgtaagctcttaccgcagtactcatagaatattccaatagcttctagttctactttgattctttctgccctctctactctgaggaccactgcaaggatatattccttaaaacacttttaaaaattatgttactctccttcactccacagtcatttactgggtgtctacaaagttggaagcatcatgctagaagctgaggtgatagtggtaaacttaccactttaggttaggtaaactatcagtttaggtgggacccttgccttcatggagtatgcagtttacttttcctctcgtctggatttcctttctgtttcttcttgactgtcgtagttcttcaaagcccacctcaaagcaaaccatttatttgaaattttctctgactattccattctcagtaatctcctcctctcccaattattgctcatagcctcaaatcataatccagcaatgcagcatctattatcttgtaatatttgattgctattattttatgcataattgtttctcatcacacggacctgggatctcaaacttaaatctccagggcccagtaaaatgagaaaagcatgccctgtctaaaggggacagctgttgatcatctccagctaatttttcccttgtgccaatgtacactctgtattataaaatctctcagcttttttagaaaagcaagaaataggatttttttcttaaaacatgaaatctgcatttgaaaggttgttagatgtttctgttttaatctttaacatcactatgagaaccaggccaacatctgcagtgggctgccagttttctctatctgacctagactgcaaatttactgaggatagaggccagagaccatgaagttttcttccttctggtattacctcctccctccttcccacataatatctactacagtgttgactatttagtagggtcttggtaaagacttgattatcatcagaaagttcccctttaagttaaccatgatgtcctgtaaatgacatagtagttctactttctccaaatacctaaatgtgcctttgaagacaattatcaggccagctttctttttccctgtccccctttttgccagatgtaatcatctacatttcttgatctagctccattttgttttcttttaaaaaaattggttatttctctagtttctttcatttttttctgcatttctcttctatttgccatttttcttgaaatattgtacatcacaaataaagtacagtatcttcagaaaggtctacatgatgctgagcatatatttaagtttgattatttggagctaattattccatctcttgtttcttcctatacgttcaatgatgcggttgtttcatcttcagttagaatgggcggggatgtgatgtgaatatatttatttcttgtttgttaaactagttctgataaatatacataacagttggtgctaaaagaataataacatacttattccttaattttgtagctagatcctagaatagatgtgtagcgttgaattggctactgcattaacctcactttctggagctctacaaactgaaatggtccaagactcttctaggatgccttgtcttggtgctcctgagccactgctcaggcagtgagtagaaaagttattcaagagccaaggtctcttcccttaagtacctgttgcacaaaacatggatgaggaccaattgtattgttacaaattatttgtggttgccacactaccaccatgtttaatttattggaggagattgttgcatgaaataaaggtatgaagtaatgaagaggatcacatgagatgttacataatgattcagagcaatgagtttttgctgctgtggctctttgtcccttagtgccatgctggagttgtaattcctagaggttttgttttataattaacataataattagtgggaatcttttaatactctgtacatatattcaatattagagtttgctgcaaagatataaaaacaccttcattattattattttcaactctaacaaactatttcaaagtacagggtagtagcaagtactttaaggaaaaaaaaagagctttggtatcaaacatcatacctggattccaatcccagctcaataatttaccagtttatgtgaccttgggattatttaatcccattgactctatttcttcatgtgtatagtgggatcaacagtaatacctacctcacagggcaattgtgaaaattaaatatgtcccattagaaatgccatgaagtgtggcacacgtttacctatgtaacaaacctgcacgtcctgcacatgtacctcaaactttaaaattaaaaaaagaaatgccatgaaatgatatatctgggatttgcataaaaatatacattgaggtagggggagtgggttgaggtacagatgaaacaaggtttaccattagctgaaaatcattgaatctgagagtaggcgcatggggtttttgtctacttttgtatgcatttaaaatcacccataatttttttttgagatggagcctcgctctttcatgcagagtggagtgcaatggcatgatctcagttcactgcaacttccacctcctgagttaaagtgactcgtgcctcagcctaccaagtggctgggactacaggcatgtgccaccacacctggctaatttttgtattttttagtagagatggcatttcaccatgttggtcaggctggtctcaaactcctgacttcaagtgatccacccgccttggcctcccaaagtgctaggactacaggcatgagccaccgcacccagtcattcatagtaattttttaaatgccattggaatgagactcaagtttacctgatggtttgtagaaaacttaatccttcttgacatcaatctcacaggttaagcagaaacctgagatgattattatggattttccatctatgtccttgtaataaaatcatatatcatagaatgttataaactggaagggatctgaaaaggactaagtagtttactcaaaatgacactgctagacaacagtgaagcctgatctagaatacaagtctcccagatcctagttaaatgattttcccattgtttcacatggccttctttaatagtaagagttttatctgcttattgcatataagattaattattgtctaaacataaatatatttgttcaatggagattcaaggcaaggggactggttctaggcatctgagattatgtttctataatacctttaaatctgttttgtcaattgattcttacaagtatcttgtgaggtgaatgaggagttatttccactttctacataaagtgacgagacttgctcaaggtcacacaacaatttactgattaaactagaactaaaatgcaggcctggagtttattgagcttcatctccacttgtatttccagttttagacttttatcataattcctcttagctttcatctttttccagaatgaggaatcttaatctctagcacattccaaggtaatttttcattctggcgtatttattttctttttgtggaaaagaaaatgtagcttaacatcagcgtctgagagaagcgcaactggctgaaagcactggaggctatgcaggtgatattgtagaacatgaactcataggagaatggagataaagatatcaaaaatcatacataagtttgttactggaaatggtttacatcttaagtatgtgaccgtatttatgtacttttaaaatttttctgacagaagtaatcctaaaaacttatatggctattttatctttacatcttataagatatttttacatgtgttatcatgattggtcttcctaacagccatgagtggggagggctacactggtgtattcccatttttcaaaggagaaaacagacatagaaaggtcaaatgacttgcccaaagttataaatcccttttctggtatttcttatcaccttatattttcaataccttatatgacttcactacttcaagtttagctggctgttgtagtaatcatgtaatactagatttcagtctttctgtcactgtcgttcatacatgttatgtgctgccagccttcatttatttttgtggcaatatgttttctcctcttaaattctgttctttttaacatcctagtttgcccccacttccttttctctcattccaggtaagctaagcaggaaaactacaggggttttctggtttgtttgttttttctttctgctggaaagatacacgtaaatttagaattagtcagctggactcagtttagatgatcccaattttgttggcaacatccaaagcattgtaatcaggagccagtcgaacgtatgccttcttctctccatcaggtcaaatcagggtgttgatttgccacatcagtatcatagagcttcttcacagcctgtttgatctggtgcttgttggctttaacatccacaatgaacacaagtgtgctgttgtctcctatcttcttcatggccgacacagtggtcagcggaaacttggtgatagcatagtagtcaagcttgtttctcctgggggcactcctccgaggatatttgggctgcctacagagtcgcagtgacttgggccgctggaaggtgaggggtgtgtggatcttcttttttgtgtgtgtggttgtggacacctttcaacactgtcttcttggccttcaaagcctttgctttggctttgactttaggaggggcaggagcttccttcttccctttccgcgccatcttatcggggttttctgttttacagctacttctgagtacctgctgtggtggtggttcttataatttagactgggtacctcaagtcactctccagcttttgtgtatgttgaaactcttgcttttttttttttttttttttttttttgagacggagtctcactctgtctcccagactagagtgcaatggtgcgacctcagctcactgcaacctccccatctcctgtgaagcgattctcttgcctcagcctcccaagtagctgggattgcaggcatgcaccaccactcccagctaatttttatattttcagtagagacagggtttcaccatgttggccaggatggtctcgatctcctgacctcatgatccacctgccacggcctccaaaagtgctaggataacaggcatgagccaccacgcccggcccaaaactcttgaatagaaaagtcatacagagctgcctgctgaggtgctacaactggaaggtgaggttgagttttccaatggtgacaggtgtgagcctgtttgggggaaatgagataaattggaggcttttgcaatctccctttattaagtagttggtttatagcaaccatttattctctgctatggaatctgcttaaaacagaagctggaagatcctactggtacccaggtaatttcattatagctgctttatgtctccagactactgaggtttaaatctcctctctgctgtttactaacttggtgatttggtggtaagcaacttcatctctctgtgccttagtttcctcatttttaaatttcattcaattcaatttaatttttattttctgtttttgaaacagggtctctctgcacccaggctagactgcggtggcacaatcatagctcactgtagcctctaccttctggtctcatgtgatcctcttgcctcagcctcacacaacaacatgcctggctaatttttaaatttttggtagagatggggtctcactatgttgcccaggctattctcaaactcctgagctcaagttatcctcccgccttggcctcccaaagtgctggaactacaagcatgagccactgtgccaggccctctttcttcctttttaaaatgaggaaataatggtgcctactactagggttgtaaggattaaatgaagatatctatagatagataaatagatataaacagaacagtgtctgacacaaagtaagcactcaatgaatgtcggctgttatagttctttttatcaccattccattattaatgtcatgctgcagagatatcctgaaggctttcccaaaggcccattgcaacactactcttaattcctctggaagatgtgcaataaaattgtctgaaaataaatgtgtactgtagtctttctcaaaacccttaagcattgatttttatttttaaatagttccagtacttcttataggttagaggccaaagatgaatgatatctgcttaagatcttcctaagtgattagttgtgttgtccttaaatgtgttcttcttttagcagacagtttttcagaaagaaggtgctcaccagatttgaggtattagaaaatggttggggagcactataatttgagtcagaggactaaagtttcagttctgattctagcacttctaaactatgtgatgtcaggcctccaaatttattatgtgtgaaatggaaattatatgaaagctgtgtatttccttactgtaaagctatgttgatgtatataagacattatttgaattgtccaaatgctgtatcctgtcaaagcacaaggtctttcttaggcccgggtcagggtttccagtgctctgctttctttttagttgtaggttctaatgactctgctttgcaccccttgtcactttatctctaggcatttttccctttcagggttggccaaaggatgggatgttttcttcttagccagcacctgctccagttccttggaggcactgttcacttttgtaagacaagctgatcattataggaaatgccacttttgtataatataaacttggggacatgacaaaagttacataattttatcaaactcctgtagtcacagtacctggaatgtggtttgtgatgtcctgcatatatgagacattgacccactggcgatgggactcaatcttcttccctatttcttcctcctctgtttccttctataggacccatgcccttaggagaaggaccagaaagtccagcttgtagacacaaaggcttgaagagccaatccaagcagaataatggttattacctcaagttggtaatttgcatttctggtgtcctcctgcctgagtgattcacatctcaatggcccaggccatatatactataacccccttttgtatatttccttaccacttccctgacagcttttgtgcagctgtctggtctctcttaggcacttagagcagaaattccaactctagagaagagcaagaggctcataaatccctcttcaaaaaaaaacagagccttctttaagaccttctgtgggccttaattttcttcagttttcaattttgcctgggtaaatattttttaaaattaaatttaaaaaaggaggttatataccttcccagtatctttccttatagtcattcctaccaatatttagaaggttgaccaggattacctaatggctattccatttggctgttttctgggtgagggcactagccagaaatggctgagacattattaattgtcagctctccctcttatactattttactaaaatatttgtgatataggagggccaagaagtatttttcaggctccttgattgttgctattaaagcttttgaagatgggcagttatagttctggatatggctctatctttcctcatttccctgatcattcattcctttattcactggacattagtacatagtgtataggagatgctctgctaaaagatagggatacaaaaaaaggaacaagactaggtaactattgaagggctcacctggtggtgaaggaaacggacagttcctctttgtgccaggtactgttgtaaatacttgaacatatatcaacttgatacatcctcatagtaattctgtgacctggtactataattattcccattttacagatgagaaaacagacacaggaggctggaaaaactttgcccaacttcttactgttaagaagtcacagaatcagaatgtgattctaggcactcactccagagcccacatgttttactacactttgagagcaatgtggagtattgaccagaaggggaaggaagtgactatgaaatgatgaagggctagatttaagagatatatctgcaggagaattattatagctgataaccaactggctgaagatagggagagaggagtcaaaggtggctgacccctaggtttttagactgatagactgggtttatggtggtgctagaaattaagattagaaatataagaggtggagcaggtttgtgaactcatggggtataaaagtcctatttgatacacaggacagattctttgggccagagttcaagattctgataatcaacaataataatggtggtgataatagctaactgagagtgttctatatgccaggatttgttttaagtgtatttacatgtacagttattcatcccttaatgaaggggatatgttctgcaaaatacatccttagacaatttttacattgtgtgaatatcatagaatgtactaacataaacctagatggtataatctactacaacctaggctatatggtatagcttattgctcctaggctacaaacttctatagcatgttactgtactggacactgtaggcagttgtagcataatggtgtatatttgtgtatctaaacatagaaaaggcacagttaaaatatggcataaaagattttaaaatggtgtacctgaacaccacttaacatgaaggaaacttgcagaactagaagttgctctgagtaagtcacttagtgagtagcgagtgaatgttaaggcctaggacattactgtaccttactttagactttttaaacagtgtacactaggctacactaaatttataaacaattttttcttataaattaaccttagcttactataacttttttagcttaaaacacaaatcctgtacagctgtacaaaaatattttatttctttgtattcttattttataagcttttttctattgttaattattttttttttgctttttacaagtttttgttaaaaactaagacacaaagacacatcagcctaggcctatgagggtcaggatcatcaatatcactgtcttctaccttatatcttgtcccactggaagatcttcaggggtaataacatgcatggagctgccgtctggtatgacaacaataccttcttctgggatacctcctgaaagacctgcctgagaatgttttataattaacttttttttagtaagtagaaggagtacactctaaaatgatgatagaatgtatagtgtagtaaatacagaaaacaataacatagtcatttgttatcattgttaagtattacatactgtatataattatattgactgacagcacagtcgatttgtttacaccagcatcaccacaaatacatgagtaatgctttgcactgtgacattacagcgggtatgatatcactaggtgataggaattttttagctctgttataattgtatagaatcattgtcgtatctatgagaacacttggacacaggaaggggaacatcacacactggggcctgtcatggggtggggggagagcggagggatagcattaggagatatacttaatgtaaatgacgagttaatgggtgcagcacaccaacatggcacatggatacatatgtaacaaacctgcacgttgtgcacgtgtaccctagaacttaaagtatgaaaaaaaaaagaacagtgtcgtatctgtgggtcatcgttgactgaaacgtcattacatggcatatgaatgtattaacatggaatgttcacattaactctgttaaggcaataccgtgttaccccctcttttggcaggtgaagaaactgaggttcatagaagctaatatagcctctcagaatcactctgcttcctcaactctgctgtctcttaatccataggaatcgaagaacagattggagttggctgtcttaagttgtacttgctagaaataatgaagcctgttgaaggtgttgtgtgaatgcagagggagaatcgaatcttctccactcctacgcatggttctggcagcaacaaagaaagctctcctggcgttttggtgcccccctgtgggctgtatgagagttacctgacctcacattctttttccaccatcacacctccttttcctgtcttagaaatcagaaaaagcttagctaccctctctaccacctctcacttcatagttaattacacctcaggcatctttcatgcataaattctctaattttctttcgttcttttccacccttttccaatttctgtacttgagaaaacacattccctcactctccttttctgtcactgtcatcaaaaaccttcgaaaatgtgattaaacacctaccatgtaccaggcaatgttctagggccttggaatacattagtgaaaaaaacaaagatgaaagtatctgcctgcaaggagctcagattctattggaagtcagttttcttaattctggcttctactattcttattacttactacagttcctccattaacctgttaaaagagaaactttagacaaattacacttaacagtttaatcgagcaaagaatgattcatgaatcaggcagcccccagaagaaataatagattcagagcaactctggggctgccatgtagtcagataatatttatggacagaaaatggaagtgaggtacagaaacagctggattggttatatctcagtatttgccttattcaaacactttgagttgttgactgcctgtaattggctgaaactctgtgattggcgcaacagtagattacactgtctacacatccagttaggttatggttcattatggatggggaaacctttaggctgaacttgaaatatgtaaggaggaagctttaagctaaccttaatttaacaaaccccacccccaagttccatggaagccttagggttctgcagaggatagtctgaaatcttttaatcatagatggacaagttgtggcttaggaaaaaaaaggccttgccaaagattatgggatgtgagtgctgcacatctaactcccagaaaatctggttgaggaagaaagctagtaggtgcttctagtatgaatgactgatggtttaaggcagctgaattaagacactaattcctttttttaagaggaaaaactaaagaagaaagagaaaactgtttttattaccccacctggcttgcagatttaagagacgtagacagataaaatacgtctctagagagatttggccttgatgtgtaaataagttcactcgggtaaatatatatataggagcttggaactccttcaagcaagaactagaccaggaaggtagaatactgaaaactgtagctatactgatgttcctctgaaggcagagcatgttggagaaataggaagaaacagattacctgcatgcagtttggtggaggggagcagctaatattattggggaaaagttaggtccatcttgatgagtaaaataaatcagaaggtttcaatgacttatcagtatctggtaagcactgaaagataaaggtcatagaacacacataacattaatggcatatttatgcatatagtgggttagattttattctgaaagttgtcttttccttttctcttttccagatatggataaactcataaacaacttggaggtccaacttaattcagaaggtggctcaatgcaggtattcaagcaggtcagttatcaggaaaatagggtgctaatattgggccataatagtattgaatacctggtagtgattacagaatttaaactcatttttctttctataacatgtttggggattgagaagaggtgaaggaagacatatttctagaaagtatatgaatgccttggtttcatagtcagctggggagtagatctggcctaaaagaaacatagcctctggaatcaaggctataaagacaagagtagacctttagtagacaatagcaactatttatatagcactatttcatatttcagataggatgaagattaaatgcattgtcttatttaatcttcaccataatcctgttgaacagtgtattaattagtattctccagagaaacagaaccaacaggatatgtgtgtatggtgtatgtgtgtgtgtatgcatatatgtacatggagagagagagagagagagatttcaagaaattggctcattagattgtggaggcatggcaagtccaaaaccccatcaggggtaggccggcaggctggagattcagaaggagttacagtttgagtccaaaagcagattgtgagaagaattctttcttgctctatggaggacagtctttgttttaaaaactaaggtcttcaactgattggttgaggaccactcacattatagagagtaatgtgccctatttaaagtacaatgttttaaatgttggtctcatccaaaaaaataccttcacagaaacatctagaataatgtttgaccaaatatctgggcactgtagcccagccaagttgtcacataaaattaaccatcattattcttagtttccccatttgatggaaaataaaactggccttgaacactccaagaattaggattcgaaacaggttatctggattttatgtcccagggctctgtgctagatgttgaagtcccgtctttcttggggttgcaaattcactgcatgagtgaaactcaaatacagtcaaaattaaccttgaaaatccttaaatcacctatagacttgagtatacagtgttgtatatacaatacttgtctgtttctttatttaattcatcagataaagttggttacatttaggaatctttttgttataatttcaacttttattttattttttgaatttttatatatttatttatttatttatttatttatttgagacggagtctcgctttgtcacccaggatggagtgcagtggcacaatcttggctcactgcatcctctgccttccaggttcaagctattcttctgcctcagcctcctgagtagctgggactacaggcacgcaccaccatgcccggctaatttttgtatttttagtagggacagggtttcaccatattggctaggctggtctcgaactcctgacctcatgatccgcccacctcggcctcccaaagtgctgggtttataggtgtgagccaccgtacctggccttatttttaatttttgtaggtacatagtaggcgtatatatttatgggatacattgagatgttttcatacaggcatgcaatgtgaaataatcacattatggagaatggggtatccatccctgcagcatttatcctttgtgttacaaacaatgcaattacactcttttagatattttttaagtgtacaattaagttattattgactctagtcaccctatcatgctatcaaatagtaggtcttatttgttatttccaacttttttttgtttttgagatggagtctctctctgttgcccaggctggagtacagtggtggcttctcagctcactgcaacctccgcctcccagattcaagcaattatcttgcctcagcctcctgagtagctaggactacaggcacatgccaccacgcccagctaattgtttgtatttttagtagagacagggtttcaccatgttggccaggctggtctcaaaatcctgacctcaggtgatctgcccatgtcggcctcccaaagtgctggggattacaggagagagccactgcacccagacaatttctaactattttttcgtacacattcaccatgaccacctcctcctcaacaccccactgcccttcccagcctctggtaaccatccttctactctctatgtccatgagttcaatggtttcgatttttagatcccacaaataaataagaacatgtgatatttgtctttctatacctgacttatttcactgaacataataatctccagttccacccatgttattgcaaatgacaggatctcattctttttatggctgaatagtactccattgtgtatctgtaacacattttctttatccattcatctgttgatgaatacttaggttgcttccaaatcttagctattgtgaatagtgctgcaacaaacatggaagtgcagatatctctttgatatactgatttcctttctttttggtatatacccagcagtgggattgctggatcatatagtagctcaattttcaatttttttgaggaacctccaaattgttctccatagtggctgtactaatttacattcccaccaacagtgcacaagtgttttcttttctccacatcctcaccagcatttattattgcctaactcttggataaaagccattttaaatatctcattgtagttttgatttacatttctctgatgatcactgatgttgagcaccttttcatatacctgtttgccatttgtatgtcttcttctgagaaatgtctattcaaatgttttacccatttttaaattgaattattagacttttttctattgagttgtttgagctcattatatattctggtgattaatctgttgtcagatgggtagtttacaaatattttctcccaatctatgggttgtctcttcactttgttgattgaatcctttgctttgcagaagctttttaattgatgtgatcccatttgttcctgtttgctttggttgcctgtgtttgtggggtattgctcaagaaatttttgcccagaccaatgtcctggagattttcccaaatattttctgcagcagtttcatagtttgaggtcttagatttaactctttaatccattttaatttaatttttgtatatggttagagatagggttctggtttcatttttctgcatatggatatccaggtttcccagcaccatttattgaagagaccacgcattccccaatgtatgttcctggcacctttgtaaaaaatgaattctttgtagatgtatggctttatttctgggttctctattttgttccattgcactgtatgtttgttttcatgccaatacaatgccattttggttactatagctctatagtataacttgaagtcaggtaatgtgattccttcagttttgttctttttgcttaggataacaggctattctcggtatttgtggtttgatataaattttcggatttcgtttttctatttttgtacataatgtctttttttctttttcttttttttttttttgagatgttgtctcactctgttgcccaggccggagtgcagtggcacaatcttggctcattgcaaccttcacctcctggcttccagcaattcttgtgcctcagcctcccaagtagcagggactatgggcatgtgccaccatgcccagctaatttttttttttttttttggcagagacggggtttcaccatgttaaccagactggtcctgaactcctaacctgaagtgatccacccacctctttgtgttcccaaagtgtgtcaacagtgaacaatctgacaaagcaacactttgcttcccaaagtgttgagattacagacatgagccactgcgcccagacaagaatgtcattggtattttgatagggattttattgaatctgtattgtgttttaggtagcattgaagcaggatatttccttgaccccttcgtgggtgggaactggagtgcactggtgctggacctagctggcgctttggcactagcaggggcgaattccactcacttaaacctgctgtgttctaccccttgtgggaggggaatcacaggtcagtgggtgcaggagctggggtgagtgcctttgggcaccggcaggagcaaaactctatgcgcaccccacagcagagtccggggggcggggtgcctgcgacccttgaagccccagaaggagtgttacagtacccttttagctttgctgtttgcagatggcttaagcattaacagctcaccagagggtcagtgtgacagccttctgcacccacactgaagttcttgtctggcatccaggaggaatgaggttacacaatgaatcaaaggtggttaatgtgggagattttattgctgatcaaagtggctatcagtgggagggggagctgaaaaggggatggagtgggaaggtaatcttcccctggattccagctgtccccatctggactcctctccaaagctatgccatcaagctgtccctctgaagtcaagccacttctctccaacatccaactataatctccaacgtttagctgcttctcctctttctgccagctgagcctgggtttttatgggcacaggatagggggcagggtcaaccatgggtggttttggaaaaggcaacattcaagcaggaaaacggaaatataagttctcactttggactgtggttccaggcttcagggtggggccctcaccagggacctgcccacttctgcctagaatttccctgcctcctgtccctgtcagtatggacatttcaacaatattgattcttccaatccatgaacatagaatatttttccattttttgatgtcctcttcaatttctttcttcagtgttttatagttttcattgtagacatctcccacttctttggttaatttgtaggtatttaattttatgtgtggctattgtaaacaggtttacttttttatttctttttcagattgttcactgttgacataaagatgctactgatttgattagtttgattttctatactgcagctttactgaatttgtttatgggttctaatagttttttgtggagtttttaggtttttccaaatataggatcatatcatctgcaaacaaaaataatttgacttctttttttccaatttgaatgccctttatatctttctcttttctgatggctctagccaggacttccaatactatgtggaataacagtgttgacaatgggcatccttgacatgtgccaggtcttagaggaaaggctttcagtttttccccattcgatatgatactagctgtgggtctgttttatatggcttttattatgctgaggtgttacttgtatccccagttttttgaagggatgttgaattttatcaaatgctttttcagcatcaattgaaataatcatggtctttaatccttcattctgttgatattatgtatcacattgattgatttgtgtgttgaactgtctttgcacccagggatcccacttggtcaggatgaaggatctttctaatatattgttgaatttggtttgccagtagcttgttgaggatttttgcatcagtattcatcagagatattggcctgtaattttctttttttgaagtgtctttgtctggttttggtatcagggtaatactggccttgtagaatgagtttggaaatagttcctcctctatttttcagaatagtttcagtagaattggtatgagctcttctttaaatgtttggtagaattcagctgtgaagccatcaggtcctgggcttttctttactaggagactttttattatggcttcaatctcattacttgttattggtctgttcatgttttggatttcatggttcaatcttggtaggttatatgtgtctaggaatttgtccatttttttctagatttttcaattcattgacatgtaattgctcatagtggctactaatgatcctttgaatttctgcaatatcagttgtaatgtctcctttttcatttctgatattatttatttggatcttctctctttttttctcattagcctggctaaaggtatgtcaattttgtttaacttttcaaaaaacaactttttgtttcactgatcttttgtattttatttcaaattcttttaattctcctctcatctttgttatttcttctactaattttggggttggtttgctcttgtttttctatttttttttccaaaagaatatgcaggtatcattgcttttctaggtctttaagatgaattattagattgtctgtttgaagttttttctgtcttctgatgtaggcacttacagctataaaacttccctcttatgactgtttttgctatattccataggttttgatatgttgttttccattatcacttgtttcaagaaatttttcaattttcttcttaatttcttcattgactcactggtcattcaggagcaatttttgttgtagttggtttttttgtttgtttgtgacagagtttcactgttgttgcccagtctggagtgaaatggtgtgatctcagctcactgcaacttctgtcccctgagttcaagtgattttcctgcctcaggctcccaaatagctgggattacaggcatgtgccaccacacctggctaattttgtatttttagtagagacggggtttctccatgttggtcaggctggtctcgaactcccaacctcaggtgatctgtctgcctcggcctcccaaagtgctgggattacaggcgtgagccaccttgcctggcaggagcatattttttaatttccctaattaagttaaagtttaataatattattaaacattaataaattaatgttttataatactactggtgtatggtgtttgtatagtttcctaaattcctcttgttattaatttctagttttattctattgtggtcagagaagatgcttgatgttatttcaggttttctgagtgtcttaaggtgtgttttgtcacctaacgtatagtctgtcactgagaatgatccttgtgctggggaaaacaatgtgtattcttcggccattggatgaaatgttctgtaaatatatattggatccatttggtctatagtgcagattaagtctgatgtttctttgttgagtgtcttcaacttttattttagattcaggggatacatgtgcaggtttgttacatgggtgtattgtgtgatgccgaggtttgggatatggatgatcttgtcaccatggtagtaagcatagtattcaatggtttttcaacccttgttctcctctctccctccttcttctagtagtacccagtgtctatttttgccatctttatgtccatgagtacccaacgtttagctctcataaataagaacatgcagtatttggtttcctgttcctgcattaattcccttaggagaatagcctctagctgtatccatattgctgcaaaagacatgattttgttcttatttatgtctacatagtattccatggtatatctttaccacattttcttgatccattccgccatcgatgggcgcttacgttgatttcatgtctttgctattgtgaataatgctgtgatgaacatataagtgcaggtatatttttggtagaatgatttattttcttttgtatatataccgagtaataggattgctgggtcaaatggtagttctgtattaagttccttgagaaatctaggagtcagttttaaaaattgttctcaatcattgtttggcccatggtgtataaatgaatttgcttaagttgcatatgcatatggatgagaatcctttgtactgttttaatgatatttagccctatttgatgtcccatttaccttaatcgtagcttttgcatttaggaattattagcacatcaaaacttgctaattgttggaaaacttctgcctgttgctagagcttactcatagttaataccaagaggaagctgagtataagtagtattagataaaaatctattgtacttgtaataaaaaatactctatgaaatgtcattgagcgtgcatagctacctttgttgttgttgttgttgttttgagatggagtcttgctctgtcacccaggcttgagtgcagtggtgtgatctcggttcaccgcaagctccgcctcctgcgttcacgccattctcctgcctcagcctcccaagtagctgggaccacaggcgcctgccaccacacctcgctaattttgttttgtactgttagtagagacagggtttcaccatgttagccaggatggtcttgatctcctgacctcgtgatctgccagcctcggcctcccaaagtgctgggattacaggcgtgagccaccgcacctggccaaagctaccttattttgagatctcagtgtacctaagtataattctagaaatgtttttctatgcattctttaggtatactgaacttccagaatttggaggcactttgaaattggttcaatgtgtagaaaagtctggatagtaagggatctaagcactttttttgtttgtttcttggcatttccaggatatcttatttttagaaaagcctgagtgcttgtgatacatggccacagcacactggccatgtctcaggtgacaaggaccaggagtttgtgttctataactacgcaatgctggcatcattctagtgtggagaagcctcctggtttgattcattataggatttgtttatttcaaaagttaggactagtgggtgggtgtgtagctcagggcacacatgctgctctcccttctctaaatttctgtatcaacataccatgcagtgaaagagcatttggttgtcacctgccctttatttttcgtttctgattacttcctacaagtgggatgtcttggtcaaaatgtatgagcagtgttagggttaaattttatcatacatgtctctcctttaccctaatttaatattgttaatatttggcacatattttcacacagcctaattctctctctctctctccccccattttattactattgtaagttgcatcaagaaactttacccctaaattattctgcatgcatcacctacaaataatgacattgtcctacataactacatcagcactgtcacgcccaagaaaatgaacaatatttccatgatactatctaactggctcatacctttcttttttttcctctctttttttaaagctgggctgctttctcagggttcatacatttctgtgccacttttccccacactgttttttctacatggattgtgcctcagtgagctagtatagctcaccaaactctttacttttcttagggttcaaattccaattctacctcttccatgaaacatacatagaaaaccccaactgtctcgaatctctagtgaaatcatgctcctggaacactaaattatctgtattagtcactaatgtggtacctgttctctattgtcaactgctttatgtaaatatctcttgtctccccagtaatattttttgtctcccaaacttcaattatttacttaccactttcacgatttttgccacatccttgccatcaatattatttacatactttaaaattatttaaataaataaataaataaatctatattagttttgtcctaagctatctggagaattctcggtttgatgtgaagtattactttcctagaattgctgaaacaaactaccacaaactaggtgggttaaaacaagagaaatgtgttctctcactgttctggaggccagaaatctgaaatcaagttattgtcagggtcatgctgcctctgaaggctttagtgaagaaacttttccttacctcttccagcttctggtacatataggtattctttggcttgtagccccatcaccccactgtcagcctgcatcttcacattaccttctcctctgtggctctgtgcgttattcctctgtatgtctcttataaggacactagtcattgaatttagggcccacccagataatccagcaggatctcttcaagatctttaattacatctgcaaagatactttttccaaaaagactctgggaattgaggtgtagacgagtgtttttgagggtcaccattcagcccactacaatgtgttatatatattttccaatgtacagtacaatagagtaagcataaatattaaaataaaataacttcatccatgtattacccaaaaacaaccttagattctttgagaaacaaaaactgatttagtatttttcacattttctatagttttgtgctaggtactaagcaaatacctagtgaacaaatatatgcatacatatacatatgtacatacatttgtacatttatgatctcattttgcctgattgtggctactaccatcccaatctcttaaaattgccgggtttgttagattaagtctaggtttctaataatacccatctccatccaccgctccattttctaatacccaaacagataatgctcttattggaaaaagaattgagttttagaaggttaaacagactttttgacctaaacatgaatgtgtacaatacatgtgtgcatatgtatccaggcataaaactaattggtttaacccagagcaaagctggaaggtacctgtttacaaaaacaggtttcctctttctgtttgggaggagcctaggctttatcgtgtttctataacatcccttcctctccttccacctactgtgctgtatatagtattttgttcttcatttctaatcttgcattaccactttcaagctccacatcagagctgtttcaaatacatgaaaaatggaaactttgtaacagttgattccactgattctcagggcctctctacctatcttaatcaaatgcttaaatatttgtgaaattaaccaacttttctcagagtttatttctagaattgagaggggtgtttcctaagaaccgaaagggtctcatctttagtaatatatgaataaataactctttttatatttttttgtccactcaaattggcttaaggaaacctgataaggattctgggtatttgaggagtagcactgtggaaattaaagcttgtcttcaaaccacccctaagtttctttgttttctttcatgcacaaccttcttcatagattcagaaatccggaaattcaggataaagtcttaaaatagcaaatggggaaagtagctattctctttgatagtgattgactagagaacacttaaaaactgaagccatcacaccacactaaaaatgaagaaagattactttaaaagaaaaatctgatgacagaacaatcctcagatgagtttcaaagctgaagtgattatattcaatgaagcatgaaataggtagccatcctgagtcatcttagtgaggattcttaaaatcaccaaaattctagggacaaaaactcactcaatcaagacttgaaggtcttcttcagaaccttcaagcataatatgctatctataaagataaggtaaagcaaatagggtgttggggttttttttaaccatagggagggttatattcaaactatggaataagttagactgtataacaatatttttattaaaattattttgatcatattgaaaaaagaatcctcagtgcacacaaacaaaacttattcaccctgatagtgtgtagatatggaatgcttgtctttaagccacaaaggaaggaacagtaaggtcaaccttgagacctacttttgagaacagtctgttttcttaagaaagcttgcattcagaagacaatatttacacccagaaaatacttgctacaagatagattcacttagacataagaggcatacttgggagtgatatgtacagaaaaaagtatgtgacactatgctttgaggaagttactattaagatactaaaacccaaacaactccccttccaacacttctctcaaagccttttgatggcaggagagaagtaatgattgaagccctgctgcagacagggtttggttaagaattggcaaaccacaaaataggtttagtctatgaaaggacaactaatgatggcctgttggagcaggaccctgtaacactgtatctcatcaaggcaataagaataggctatcagttcttcagtttcttgactttcatcaatcagtttccattttagatgttcctacgtaatgtttttcaataaaatgcatacctgcagatcaagtatcagctaaacacaaggccttgagctagtaacattgttgtaggcagcactcatctcactgaaatggcctttctttggcaaaagagagtaaaagttgccaaagtcgtgtttattttatagttaggattcaaagcttcagctttttcaggtttcttagtccaaaaagtccctaaaatttagctaaatcttttcttaatttcagtggcaagttgtgtttatttatacacctgcacccacaactatattcttacagaaaatgatattacagtgaattattattattattattattatttttgtgtgacagagtctcattctgttgcccaggctggagggcagtgacaatcctcctgcctcaacctccagagtaactgggactacaggtgcatgctaccatacctggctaatttttgcatttttagtagagatggggttttaccatgttggccaggctggtctcgaactcctgacctcaagtgatccacctgccttggcctcccaaagtgctgggattacaggcatgagccaccgcgcccgccctacactgaacctcttcttatgctttctattgtaactctatttctcactgttattgacagcaatgatagactatggaaagagataacattttttcttttgaagattccttggattctatctttttaatctgggaatggagctactcaagtgaagagttatgtgggaaatgtaggaaaaataagagcttaagttgatttgggggattctgagaacaggggagttttatgttcagcagagccaatcttgacaacttcctctccctgtcaacaggattctactccccccttatctggatgggtcaaatccacccatgagggatgggttacatttgcagtatgtgaaacagtgggacaaatcacagaaatcatgtcctggaggagcagattgaagcaatgtttggaccacaaacaagggctgagttgggataggtgctggcaaatcaagaaaccaagagtgttgtagcataaaagaagggaaaagaagatggcagtctggccaaattctggagacaaagcacggatgggtttttggtgccgttactcattcccagcctgctctgagcattgttgtcatgtgtttttgacgcagagtcttgctctgtcacccagactggagtgcagtggtgtgattatagatcactgcagcgctctgagggtttttaaaataaagtcagagcaagaagacactgcctcccctgccacttattgctctctgaattcagacccttattatctctcacctaaattttaaaaaatcataagcataacataattatcacaccttaaaattaactaattcattaatattgtccaatatccagtcaatactcaaatatttttacatgtctcatcgagatttttccacttgctttcttttgaatgtctttgaatctagttttattcctctttcaatcaatcttcattaagaagctagttaaatctcacagaaatagttcttcccttgttactcctctcttccaaacaattatcttctatcacccaacctttcattgaactctacctttcctcatcttccaaatatacaaaactaaaagtggttatgttttatataaaggatgtattccttaacatttttcataatttaaaactcccataattcaagtatcatgctgatagataatggaagcttgtttgtttactggctaaagaggtggtaccaccatctccaaaatcatcttcaagatccagagtgttgcttggcagtggcatacacagttcattatatccttgacctttgaattcatggaattcttagaaagtttttaattaggttgaggctttatttcatatattacatataaatgatcatttattagttttttaaaaaaagtattagttttttattaaaaactattagttttttaaactaataaatgtatttattagttttttaaactaatgtatttattggttttttaaactaataaatgtatttattggttttttaaactaataaatgtatttattggttttttaaactaataaattggttttttaaactaataaatttatttattagtttaaatcatttatgatcatttagatcatttattagttttttttaaaaatcccagaattaaaaagttgcagagttcaattttgcatataatacaactaactgtattgcaagtttatttcatagtttattctataattatactgtctgttgttatggctctatagacaggaatatctttcttatctcttatctgcctagaaaatttctattaattttctatgactcagctgaaatatcacctcctccttgaagccttccctttctagtcagaatgagtcattcccttttgtttttctaaaacgccttgcttgtatgcctgttacattatttattatggtatgatttataaactattcacattattctatcattatatttaatatgttggtatgtacttattggctgtactttattgatgtgtgctgccactgagcttatagtagatgctcagaaagtgttgactttaaataattttgcaagattattgtgaacgttaaatgaaataatttttaacaattgccggatacagtacctggtacttacagatagtaaagtttcccgtctgtttttctctttagtttactcctgccttatttctcccagcaccatgtattccttccatgtgaaatgaatagagatttcttttttacattgcttgcatgtctcttcagggtactaacactgacttatgcatctctcatttgtttatttatttaaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcaggtaagtaacaatattgcctctttcctggccttcctgaatctattcccttttagagtcatcctatctcctgtctcttttcacttcctccaattattcttgcacactgcttcaagagtaatctttcaaaagtactgttttttatgtctttttaatgcttaagaatgtacaatgagtcttgattagaccatgcttctcaaacaagtacaagtatgcatatctatcagtgacatatcaaacaacttcctggaacttccacattatttgatattaaataatttaagcattttatatttaaaatatgattatcttgtattacaaaatgcaaaatttaaaaacctgttaagataaaccacatgcttcaaaaatagttgaagcttactaaaggcatccaccctcggacttttcaggagaatgtgtttattttatgccattcagaatgctttggtgggaaagttgagaacaatatttctatctcaaacatacttagccagtattagctcctgcctctaccaatactttcccttttctcttccctacaaaagaagtaattgaaatattgtcatcttccctgtgttcttcctcatttggcatctatcactttccattttacttatttatttgcctgtatcacaagagtttgggcattattcacaactgaattgtaaattcctgaaaaataatactctatcttaatttttttatgtatgcctccagagaacttaacacagtgctaggagttgtcttgcaacagataatttgatgaacaaacaaacttgaaaatttgtccaagagagaattcaaatgctataatcttccattttattttatttttaaaataagttcagaattcagaaaggtataaattaagtctctcttccaccactatcccccaaccactagttttcctcccagaggtatatctgttttagtttgtaatcaggaatgatcaaggaaaattatgtggcctctaaagcaggctgataatgttttgcataaatcggaaaggccaaggggtggaaatgactaggaagcagatttcagcttactgtaaaagagtatctacccttgaaatttgatgccctgtactaaatgtaggaggctgaaaaacaacatactactaagcatcaagttgctgagactctgcactggtcttctgaatacaaatattattattgactagtggttaattgtggtaatgataagtgttcataatcttattttgagatgtgatatccattccatatatgaagggagagccaaacaaacaaaccaaaaaaaggaaacaaacaaaaaaggaaataaaattcctcgtgtgacagtttatgctgagataaaggcagtggtaacatcaaaggatggtttgaaggagctttgaatagtccccataatatcatcagtccatcagagccactctaaataaacaggataaattttaaatgtgctcaatgtggttccaagctaagggcattggcccaatggtgtctgtattagttcgttttcatgctgctgataaagacatactcgagactgggaagaaaaagaggtttaattggacttacagttccacatagctggggaggcctcagaatcatggtgggaggcaaaaggcacttcttacatggtggcagcaagagaaaaggaagaaagaatagcggaaagccctgataaacccatcagatctcatgagacttattcactatcatgagaatagcaggggaaaactggccaccatgattcaattaactcctcctgggtccctcccacaacatgtggaaattctgagagatacaattcaagttgagatttgggtgggggcacagccaaaccacatcagtatccaaaatggggggcttactaaaccttagggggcacatataaaacaattggagtgcaagaagaaagtatcaaaatttgtattttcttacccttaaaaattgacaggtaatattgtatgttttaatcatctatagcatgatgttttgaagtacatatgcattgtggaatggttaaatctagctaaataataaatgcattacctcattatcatttttgtggtgagagcacttaatgtccattctctttacaattttaataaataaaatgtatcatcattaactatacttgccttgctatacaatagatctcttgaaatgtattcctcctatctagctataattacgtatcctttgaccaatatctccccatccccctccccactagccaccccagcctctggtaactaccattctactctacttgcatgagattaacttttttagattccacatatgagtgagatcatgcactatttgtccttctgtgcctggcatatttcacttaacataatgtcctccaggttcatctatgctctcacaaatggcaggattttattctttgttataactgaataatattatattgtatatatatatatgtcacatttcatttattcattcatttgttgatagatattttaggttggttccacatcttggctgttgtgaataatgctgcactaaacagggatgcagttatcttttgggcatgtgattttatttcctttggatatatacccagaagggagattgccagatcatacggtagttctaattttaagtttttgaggaacctccatactattttccataaaggctataactagtttacattcccatcaacagtgtgtaagtgttcccttttctccacatactcaccagcacttactgtcttttgtcttttcgataatagtcactctaacttaagtgagatgacatactactttttgtttgttttcttataatgtatacaaaattgtaggataccgatacatgtatatcacatacatgcacaaacatgcacacctcaagatacatgcttaaaactttttagtgaatgatatgcaaagtatagagacaactcttttaaccaaatacttgttccccaccttatcaccacccccaagtttcttctctatagaaattttgaaggtttcactggatctaggagactgttgaccacctgattgagtttttaggaattagaaacatcaggggttgataataaggaatatttgacagcttctcccaacataggtggaaaggaaggttgtatcaagcacctactaggtggtaggtatacgtttcatctcattgacttatttctgtttaggagcacaaaggccaaggtggatgttctcacatctggactaatcctagaatttgattttaggacagccaggagctattcagtgagttcaattcaacacacacacacacacacacacgttgaaactaacttttcagctgaccctgtcctggtagctggagatagaaagatgaatcatacccagaccacatcctagagacactctcatttgataccactcatagtggtatcagaactcttcatactactcttactttaaaggcatttctgttccctgctatgcaaaaaaaaaaaataaa

SEQ ID NO: 5692 - DNA, 55452 bp, human
cctttgggcctagcagggccagagaaagacggaatcactctacccactcaggttgcccagagagcactttaggttctgactcgcgtggggcgcgaggtaccccgtggggcagctaggtgcctccaagaaaccccgccccagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtggtatctcctcgtgggttcctgtcttgaaggatttcttctccgcctcaactttatgttcaagtagcgctttgggggttgggttggttttcatagcccccacccccggccctctccttttaaagggtgtgtggagttcagaggatgggtggagagcgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcggtaagtgactctgggactaatacccacccactcccacctctttcgtctagattctatccccctcccagtccccctgctccccccacacaccccacttggggtttcagcagtgggggcgggagcggaaggttaagaacactatgtggaatcaaatgaaactcaagggaaaatgactttgctaaagggctgggcaaagaaaggccaagaaggagaggagagagcttggtggaagaagtgaaagggggcaagaatggatggatttgtctagtctagtctcccctggctcggcactcccaatactccttaagcggtaaggattgtctttgacttaaccccacacagccaaagtcacaaccagagagaacaggattcacaaggccaaagctcccaggtaaccccctgaagccatagcgggtacctagagaagcttctgaaaagaaggaggaggggacagtggtttaaggtgcaaagttaggctattggaggcacagagtgaggcctggaagcagctgcgggggaggagctgctttgggcgtgccagctctttaaggaggggctgagcttggttggagaaggaagccagagcctaggctctgctccggccctttaagacgtggccaaggcagttggttcgtctgtgtaggtggaagactgactgggccgagttgctgtgattgctgaagtgaatccatttgtttagccacttggcggagctgtctttttgtgggcttttttttttaaccctaagaatttgggaaaaaataaatcacatccaaacaggtggccaaaggcaccatgtcttatttcttttggtattatattcatcgtgaagaaacgcatttattaagcacctgtcacccagtgtggtaataattgagcaaaaagaataatctttaaatttggatttgaaactgatggagattgccatggtttggggtaatctgctttgaaaccctagtatcaccacttattagctgcatcaccctgggccttgcttttctcttccatagaatgcagattaataattctatctcagtagatactcgggtggatgaaatatcttgtgtatgtggcagaggctgccacttgtatcttagttcaacttcccttttctactcagtttggaactatttttctggaccactgctgataaaattagtgtttttctgtccttaaaacaccttccagatgtggtaaaacgaaacttaggaagactgaattagtttgtccaaaggctgaggctagaacacaggttttatttgcttctgatttaacattgtttccaccagacttcatcacttctgaaagaaagggctactagcctgccttttctctcattctttgggcaacttaaccagaatgatataaccaacaggacttttggacaacagaaacaagtgataggtaaatgacctcatcccattcttcagagttatggggaagcccttgagagttgttgacctttggtgactgctggggacacagagaatgggtggggagcaatgtcttcaggtaagcctggagggcagacaggcagaaaacataggaagagtagaaataataacctcaaaagtaaaaatgacaggtgcatctatgtagtccaccctcaagaccaacttacttaatggctgtaccttcagagccctcaggagctatacatccctcttgtttagacttttcagggcacattggaaattgggaaaaaaataaccatgtagcagactaccatcaccactctcattgttctaatacatgcatttctgaggtggggttctcattggctaagtgaattccaataaccaaagtagcaaacagagcctagtcatttttgatcttgccagattgtctgtgcctggtgcggtgggggcagtatatgatcttctaagatctagctttacaatgccatgattttgtgaatgaaggaaaacttaattaggatgattgacatagatgatcatctagtatgattaccatcttattgttaagtagagtatgaataagggaataacattgtagtattgggctcatttgtttattcaaagacagtgtgagatcatgtttggtattcttcctgatttttttttttttttttgacacggtgtttcgcccttgttgcccaggctggagtgcaatggcgtgatctcggcttgccgcaaccttcgcctcccaggttcaagtgattctcctgcctcagcctcctgagtagctgggattacaggcatgcaccaccatacctggctaattttgtatttttagtggagacggggtttctccatgttggtcaggctggtctcgaactcccaacctcaggtgatccatccacctcagcctcccaaagtgctgggattacaggcatgagccacgtgcccaacctcttcctgatttttatatgctaatgtttactatcctcaactgagtttcatcatttagcctgtttcctcatctctaaaatgacatgataatttgtgattataaataatgtaaggaaagcattgaactcagtgcctgatatctaatatgtttcataagttgcggtctcatcatttttgttatttaaaaaaatttgttttatttaaatgctgctgtgtgtttgcagaagtggaatgtagattagtggacaggaagctggatttaaatatatgaaaggtgctagatgttctgtataatatactaaaagatgttatttgtgtatttagacaaaatagatgtgatgtgggcaaactaagctctaggattattaaggagcaataacctaactcaagagcccaatccagatatttcaaatcactagcaatttgacattttgttgtaacctcacactcaccatttctaatatacagcccatcatcacctctggactcttcactcattcctcattcaagactcttcctttcacttccctggttctgcaacttactatgaccatagtaatggtgaacttatttaaactctgtactttagttgtcatatctgtgcattggggataataatagacactacctcataaggttgctgtgaggaataagtgtgttaattttgtaaacacttagaaggcggcatgaaagtgaagcagtgggaaaatgtagctgttgtggtactcatgtccctttcccctcttcctcattttctcatttaattagatgccaatggctgttgtattttttcccctttgtatctggtatctgtttctttattattattctaactgccaccaccttaatttaggcgagacgtgcaaacaattagcctacagaccaactaaagctcacacgtgttttgttttccctaaaatttaaaaactttcaactaaaacatgcattttcaattggtaatgcattccgcctggctcaaaattcagtatttactaaagggtgcatggtgaaaaaagtctccctcctattcctgttctctagccacccattttgcctcgctggaggcaactaatgttatctatttattaggaatctctccagggatatttagtgtatatcaagcaatgagtatgtttgtgtgtgtgtgtgtgtgtgtgtgtgtgtgtgaataacattgtagtattgggctcatttgtttactcaaagataatgtgaaatcatgtttggttttctatagatagatagatggatatatatatatatatatatatggttcagtatcttctgattattcaaaagaaactggaattctaggaatttaagtgaaatctgattttgaaatactggttatcaatcaacttttaaaagtgtgggactaggcaacttgacatactgacatgaactgaattgtgacccccccatcccccccaaaaaaattcatacattgaagacctaatacctaagcttgtgactgtatttggagatagggcctttaggaaagaaattaaggttagatgagctcatattatatataatacatatataatattagtatatatgtaagtaccacaacaactatattttctcactgcttacttcactttcatgccttcttctaagtgtttacaaaattaacacacttattcttcactgcaaccttatgaggtagtttctattatatatatatgtgtgtgtgtgtgtgtgtttgtgtgtgtgtgtgtatatatatatccccttcaccttttatacacagatagtaacacattctgcatattgttctctacaacttgcttgtctacttaaaaatatactttggagatattttcatatatgcacattttttaaatgcctcattcttttttatgactgcataggtttttactatatgcatgagccacaaatttttaaacagttttctgttgattgatctttaagttatttccaaacttttgcagtgttatttgtaataacaataaaaacttttgtaagcagtgcattagagagctcaggctgccataacaaaataccattgactgagtggcttaaacaacagaaatgtattttctcacagttctggaggctgggagtccatgatcagggtgccaacatggtcagattttcatgaggactctctttctgacctgtagaaggccaccttttcactttgtactcatgtgatctttgtacaaatgggaggagaaagagtgaattctctctggtgtgtcttcttagaaagacactaatcctatcagatcagaacctcacctttatgagctcatttaaccttaatttctttcctaaaggccctatcttcaaatatagtcactaggttaggtcttctacctattaatttttttttggagagtggacacaacacaagtcagttcatagcagtgtgtcaaattgcctagtcccacacttttaaaagttggttgattgccaatatttcaaaatcagatttcccttaaaattctagaattctaggccgggcgcagtggctcatgcctgtaatcccaggactttgggaggccaaagcaggaggatcacctgtcagcagttcgaaaccagcttgaccaacatggtaaaaccccatctatattaaaaatacaaaattagccgggtgtggtggtgcatgcctgtaatcccagctactcaggaacctgagacaggagaatcgattggacctgggaggcggaggttgcagtgagccgagatcacaccattgcactccagcttgggcaacaagagtgaaactccgtctcaaaagaaaacaaaaattcttcaattccagtttcttttgactaatcagaagatactgaaccagcattctctcttggcaataattgcctagagttgatgagcctctccctccctcccctttaaaacagtacttgtattttttgttcaccacattactcatctggcctaggtggccttaacctgtctgacccctagtctagatattgagattatggcacctatgtaagctcttaccgcagtactcatagaatattccaatagcttctagttctactttgattctttctgccctctctactctgaggaccactgcaaggatatattccttaaaacacttttaaaaattatgttactctccttcactccacagtcatttactgggtgtctacaaagttggaagcatcatgctagaagctgaggtgatagtggtaaacttaccactttaggttaggtaaactatcagtttaggtgggacccttgccttcatggagtatgcagtttacttttcctctcgtctggatttcctttctgtttcttcttgactgtcgtagttcttcaaagcccacctcaaagcaaaccatttatttgaaattttctctgactattccattctcagtaatctcctcctctcccaattattgctcatagcctcaaatcataatccagcaatgcagcatctattatcttgtaatatttgattgctattattttatgcataattgtttctcatcacacggacctgggatctcaaacttaaatctccagggcccagtaaaatgagaaaagcatgccctgtctaaaggggacagctgttgatcatctccagctaatttttcccttgtgccaatgtacactctgtattataaaatctctcagcttttttagaaaagcaagaaataggatttttttcttaaaacatgaaatctgcatttgaaaggttgttagatgtttctgttttaatctttaacatcactatgagaaccaggccaacatctgcagtgggctgccagttttctctatctgacctagactgcaaatttactgaggatagaggccagagaccatgaagttttcttccttctggtattacctcctccctccttcccacataatatctactacagtgttgactatttagtagggtcttggtaaagacttgattatcatcagaaagttcccctttaagttaaccatgatgtcctgtaaatgacatagtagttctactttctccaaatacctaaatgtgcctttgaagacaattatcaggccagctttctttttccctgtccccctttttgccagatgtaatcatctacatttcttgatctagctccattttgttttcttttaaaaaaattggttatttctctagtttctttcatttttttctgcatttctcttctatttgccatttttcttgaaatattgtacatcacaaataaagtacagtatcttcagaaaggtctacatgatgctgagcatatatttaagtttgattatttggagctaattattccatctcttgtttcttcctatacgttcaatgatgcggttgtttcatcttcagttagaatgggcggggatgtgatgtgaatatatttatttcttgtttgttaaactagttctgataaatatacataacagttggtgctaaaagaataataacatacttattccttaattttgtagctagatcctagaatagatgtgtagcgttgaattggctactgcattaacctcactttctggagctctacaaactgaaatggtccaagactcttctaggatgccttgtcttggtgctcctgagccactgctcaggcagtgagtagaaaagttattcaagagccaaggtctcttcccttaagtacctgttgcacaaaacatggatgaggaccaattgtattgttacaaattatttgtggttgccacactaccaccatgtttaatttattggaggagattgttgcatgaaataaaggtatgaagtaatgaagaggatcacatgagatgttacataatgattcagagcaatgagtttttgctgctgtggctctttgtcccttagtgccatgctggagttgtaattcctagaggttttgttttataattaacataataattagtgggaatcttttaatactctgtacatatattcaatattagagtttgctgcaaagatataaaaacaccttcattattattattttcaactctaacaaactatttcaaagtacagggtagtagcaagtactttaaggaaaaaaaaagagctttggtatcaaacatcatacctggattccaatcccagctcaataatttaccagtttatgtgaccttgggattatttaatcccattgactctatttcttcatgtgtatagtgggatcaacagtaatacctacctcacagggcaattgtgaaaattaaatatgtcccattagaaatgccatgaagtgtggcacacgtttacctatgtaacaaacctgcacgtcctgcacatgtacctcaaactttaaaattaaaaaaagaaatgccatgaaatgatatatctgggatttgcataaaaatatacattgaggtagggggagtgggttgaggtacagatgaaacaaggtttaccattagctgaaaatcattgaatctgagagtaggcgcatggggtttttgtctacttttgtatgcatttaaaatcacccataatttttttttgagatggagcctcgctctttcatgcagagtggagtgcaatggcatgatctcagttcactgcaacttccacctcctgagttaaagtgactcgtgcctcagcctaccaagtggctgggactacaggcatgtgccaccacacctggctaatttttgtattttttagtagagatggcatttcaccatgttggtcaggctggtctcaaactcctgacttcaagtgatccacccgccttggcctcccaaagtgctaggactacaggcatgagccaccgcacccagtcattcatagtaattttttaaatgccattggaatgagactcaagtttacctgatggtttgtagaaaacttaatccttcttgacatcaatctcacaggttaagcagaaacctgagatgattattatggattttccatctatgtccttgtaataaaatcatatatcatagaatgttataaactggaagggatctgaaaaggactaagtagtttactcaaaatgacactgctagacaacagtgaagcctgatctagaatacaagtctcccagatcctagttaaatgattttcccattgtttcacatggccttctttaatagtaagagttttatctgcttattgcatataagattaattattgtctaaacataaatatatttgttcaatggagattcaaggcaaggggactggttctaggcatctgagattatgtttctataatacctttaaatctgttttgtcaattgattcttacaagtatcttgtgaggtgaatgaggagttatttccactttctacataaagtgacgagacttgctcaaggtcacacaacaatttactgattaaactagaactaaaatgcaggcctggagtttattgagcttcatctccacttgtatttccagttttagacttttatcataattcctcttagctttcatctttttccagaatgaggaatcttaatctctagcacattccaaggtaatttttcattctggcgtatttattttctttttgtggaaaagaaaatgtagcttaacatcagcgtctgagagaagcgcaactggctgaaagcactggaggctatgcaggtgatattgtagaacatgaactcataggagaatggagataaagatatcaaaaatcatacataagtttgttactggaaatggtttacatcttaagtatgtgaccgtatttatgtacttttaaaatttttctgacagaagtaatcctaaaaacttatatggctattttatctttacatcttataagatatttttacatgtgttatcatgattggtcttcctaacagccatgagtggggagggctacactggtgtattcccatttttcaaaggagaaaacagacatagaaaggtcaaatgacttgcccaaagttataaatcccttttctggtatttcttatcaccttatattttcaataccttatatgacttcactacttcaagtttagctggctgttgtagtaatcatgtaatactagatttcagtctttctgtcactgtcgttcatacatgttatgtgctgccagccttcatttatttttgtggcaatatgttttctcctcttaaattctgttctttttaacatcctagtttgcccccacttccttttctctcattccaggtaagctaagcaggaaaactacaggggttttctggtttgtttgttttttctttctgctggaaagatacacgtaaatttagaattagtcagctggactcagtttagatgatcccaattttgttggcaacatccaaagcattgtaatcaggagccagtcgaacgtatgccttcttctctccatcaggtcaaatcagggtgttgatttgccacatcagtatcatagagcttcttcacagcctgtttgatctggtgcttgttggctttaacatccacaatgaacacaagtgtgctgttgtctcctatcttcttcatggccgacacagtggtcagcggaaacttggtgatagcatagtagtcaagcttgtttctcctgggggcactcctccgaggatatttgggctgcctacagagtcgcagtgacttgggccgctggaaggtgaggggtgtgtggatcttcttttttgtgtgtgtggttgtggacacctttcaacactgtcttcttggccttcaaagcctttgctttggctttgactttaggaggggcaggagcttccttcttccctttccgcgccatcttatcggggttttctgttttacagctacttctgagtacctgctgtggtggtggttcttataatttagactgggtacctcaagtcactctccagcttttgtgtatgttgaaactcttgcttttttttttttttttttttttttttgagacggagtctcactctgtctcccagactagagtgcaatggtgcgacctcagctcactgcaacctccccatctcctgtgaagcgattctcttgcctcagcctcccaagtagctgggattgcaggcatgcaccaccactcccagctaatttttatattttcagtagagacagggtttcaccatgttggccaggatggtctcgatctcctgacctcatgatccacctgccacggcctccaaaagtgctaggataacaggcatgagccaccacgcccggcccaaaactcttgaatagaaaagtcatacagagctgcctgctgaggtgctacaactggaaggtgaggttgagttttccaatggtgacaggtgtgagcctgtttgggggaaatgagataaattggaggcttttgcaatctccctttattaagtagttggtttatagcaaccatttattctctgctatggaatctgcttaaaacagaagctggaagatcctactggtacccaggtaatttcattatagctgctttatgtctccagactactgaggtttaaatctcctctctgctgtttactaacttggtgatttggtggtaagcaacttcatctctctgtgccttagtttcctcatttttaaatttcattcaattcaatttaatttttattttctgtttttgaaacagggtctctctgcacccaggctagactgcggtggcacaatcatagctcactgtagcctctaccttctggtctcatgtgatcctcttgcctcagcctcacacaacaacatgcctggctaatttttaaatttttggtagagatggggtctcactatgttgcccaggctattctcaaactcctgagctcaagttatcctcccgccttggcctcccaaagtgctggaactacaagcatgagccactgtgccaggccctctttcttcctttttaaaatgaggaaataatggtgcctactactagggttgtaaggattaaatgaagatatctatagatagataaatagatataaacagaacagtgtctgacacaaagtaagcactcaatgaatgtcggctgttatagttctttttatcaccattccattattaatgtcatgctgcagagatatcctgaaggctttcccaaaggcccattgcaacactactcttaattcctctggaagatgtgcaataaaattgtctgaaaataaatgtgtactgtagtctttctcaaaacccttaagcattgatttttatttttaaatagttccagtacttcttataggttagaggccaaagatgaatgatatctgcttaagatcttcctaagtgattagttgtgttgtccttaaatgtgttcttcttttagcagacagtttttcagaaagaaggtgctcaccagatttgaggtattagaaaatggttggggagcactataatttgagtcagaggactaaagtttcagttctgattctagcacttctaaactatgtgatgtcaggcctccaaatttattatgtgtgaaatggaaattatatgaaagctgtgtatttccttactgtaaagctatgttgatgtatataagacattatttgaattgtccaaatgctgtatcctgtcaaagcacaaggtctttcttaggcccgggtcagggtttccagtgctctgctttctttttagttgtaggttctaatgactctgctttgcaccccttgtcactttatctctaggcatttttccctttcagggttggccaaaggatgggatgttttcttcttagccagcacctgctccagttccttggaggcactgttcacttttgtaagacaagctgatcattataggaaatgccacttttgtataatataaacttggggacatgacaaaagttacataattttatcaaactcctgtagtcacagtacctggaatgtggtttgtgatgtcctgcatatatgagacattgacccactggcgatgggactcaatcttcttccctatttcttcctcctctgtttccttctataggacccatgcccttaggagaaggaccagaaagtccagcttgtagacacaaaggcttgaagagccaatccaagcagaataatggttattacctcaagttggtaatttgcatttctggtgtcctcctgcctgagtgattcacatctcaatggcccaggccatatatactataacccccttttgtatatttccttaccacttccctgacagcttttgtgcagctgtctggtctctcttaggcacttagagcagaaattccaactctagagaagagcaagaggctcataaatccctcttcaaaaaaaaacagagccttctttaagaccttctgtgggccttaattttcttcagttttcaattttgcctgggtaaatattttttaaaattaaatttaaaaaaggaggttatataccttcccagtatctttccttatagtcattcctaccaatatttagaaggttgaccaggattacctaatggctattccatttggctgttttctgggtgagggcactagccagaaatggctgagacattattaattgtcagctctccctcttatactattttactaaaatatttgtgatataggagggccaagaagtatttttcaggctccttgattgttgctattaaagcttttgaagatgggcagttatagttctggatatggctctatctttcctcatttccctgatcattcattcctttattcactggacattagtacatagtgtataggagatgctctgctaaaagatagggatacaaaaaaaggaacaagactaggtaactattgaagggctcacctggtggtgaaggaaacggacagttcctctttgtgccaggtactgttgtaaatacttgaacatatatcaacttgatacatcctcatagtaattctgtgacctggtactataattattcccattttacagatgagaaaacagacacaggaggctggaaaaactttgcccaacttcttactgttaagaagtcacagaatcagaatgtgattctaggcactcactccagagcccacatgttttactacactttgagagcaatgtggagtattgaccagaaggggaaggaagtgactatgaaatgatgaagggctagatttaagagatatatctgcaggagaattattatagctgataaccaactggctgaagatagggagagaggagtcaaaggtggctgacccctaggtttttagactgatagactgggtttatggtggtgctagaaattaagattagaaatataagaggtggagcaggtttgtgaactcatggggtataaaagtcctatttgatacacaggacagattctttgggccagagttcaagattctgataatcaacaataataatggtggtgataatagctaactgagagtgttctatatgccaggatttgttttaagtgtatttacatgtacagttattcatcccttaatgaaggggatatgttctgcaaaatacatccttagacaatttttacattgtgtgaatatcatagaatgtactaacataaacctagatggtataatctactacaacctaggctatatggtatagcttattgctcctaggctacaaacttctatagcatgttactgtactggacactgtaggcagttgtagcataatggtgtatatttgtgtatctaaacatagaaaaggcacagttaaaatatggcataaaagattttaaaatggtgtacctgaacaccacttaacatgaaggaaacttgcagaactagaagttgctctgagtaagtcacttagtgagtagcgagtgaatgttaaggcctaggacattactgtaccttactttagactttttaaacagtgtacactaggctacactaaatttataaacaattttttcttataaattaaccttagcttactataacttttttagcttaaaacacaaatcctgtacagctgtacaaaaatattttatttctttgtattcttattttataagcttttttctattgttaattattttttttttgctttttacaagtttttgttaaaaactaagacacaaagacacatcagcctaggcctatgagggtcaggatcatcaatatcactgtcttctaccttatatcttgtcccactggaagatcttcaggggtaataacatgcatggagctgccgtctggtatgacaacaataccttcttctgggatacctcctgaaagacctgcctgagaatgttttataattaacttttttttagtaagtagaaggagtacactctaaaatgatgatagaatgtatagtgtagtaaatacagaaaacaataacatagtcatttgttatcattgttaagtattacatactgtatataattatattgactgacagcacagtcgatttgtttacaccagcatcaccacaaatacatgagtaatgctttgcactgtgacattacagcgggtatgatatcactaggtgataggaattttttagctctgttataattgtatagaatcattgtcgtatctatgagaacacttggacacaggaaggggaacatcacacactggggcctgtcatggggtggggggagagcggagggatagcattaggagatatacttaatgtaaatgacgagttaatgggtgcagcacaccaacatggcacatggatacatatgtaacaaacctgcacgttgtgcacgtgtaccctagaacttaaagtatgaaaaaaaaaagaacagtgtcgtatctgtgggtcatcgttgactgaaacgtcattacatggcatatgaatgtattaacatggaatgttcacattaactctgttaaggcaataccgtgttaccccctcttttggcaggtgaagaaactgaggttcatagaagctaatatagcctctcagaatcactctgcttcctcaactctgctgtctcttaatccataggaatcgaagaacagattggagttggctgtcttaagttgtacttgctagaaataatgaagcctgttgaaggtgttgtgtgaatgcagagggagaatcgaatcttctccactcctacgcatggttctggcagcaacaaagaaagctctcctggcgttttggtgcccccctgtgggctgtatgagagttacctgacctcacattctttttccaccatcacacctccttttcctgtcttagaaatcagaaaaagcttagctaccctctctaccacctctcacttcatagttaattacacctcaggcatctttcatgcataaattctctaattttctttcgttcttttccacccttttccaatttctgtacttgagaaaacacattccctcactctccttttctgtcactgtcatcaaaaaccttcgaaaatgtgattaaacacctaccatgtaccaggcaatgttctagggccttggaatacattagtgaaaaaaacaaagatgaaagtatctgcctgcaaggagctcagattctattggaagtcagttttcttaattctggcttctactattcttattacttactacagttcctccattaacctgttaaaagagaaactttagacaaattacacttaacagtttaatcgagcaaagaatgattcatgaatcaggcagcccccagaagaaataatagattcagagcaactctggggctgccatgtagtcagataatatttatggacagaaaatggaagtgaggtacagaaacagctggattggttatatctcagtatttgccttattcaaacactttgagttgttgactgcctgtaattggctgaaactctgtgattggcgcaacagtagattacactgtctacacatccagttaggttatggttcattatggatggggaaacctttaggctgaacttgaaatatgtaaggaggaagctttaagctaaccttaatttaacaaaccccacccccaagttccatggaagccttagggttctgcagaggatagtctgaaatcttttaatcatagatggacaagttgtggcttaggaaaaaaaaggccttgccaaagattatgggatgtgagtgctgcacatctaactcccagaaaatctggttgaggaagaaagctagtaggtgcttctagtatgaatgactgatggtttaaggcagctgaattaagacactaattcctttttttaagaggaaaaactaaagaagaaagagaaaactgtttttattaccccacctggcttgcagatttaagagacgtagacagataaaatacgtctctagagagatttggccttgatgtgtaaataagttcactcgggtaaatatatatataggagcttggaactccttcaagcaagaactagaccaggaaggtagaatactgaaaactgtagctatactgatgttcctctgaaggcagagcatgttggagaaataggaagaaacagattacctgcatgcagtttggtggaggggagcagctaatattattggggaaaagttaggtccatcttgatgagtaaaataaatcagaaggtttcaatgacttatcagtatctggtaagcactgaaagataaaggtcatagaacacacataacattaatggcatatttatgcatatagtgggttagattttattctgaaagttgtcttttccttttctcttttccagatatggataaactcataaacaacttggaggtccaacttaattcagaaggtggctcaatgcaggtattcaagcaggtcagttatcaggaaaatagggtgctaatattgggccataatagtattgaatacctggtagtgattacagaatttaaactcatttttctttctataacatgtttggggattgagaagaggtgaaggaagacatatttctagaaagtatatgaatgccttggtttcatagtcagctggggagtagatctggcctaaaagaaacatagcctctggaatcaaggctataaagacaagagtagacctttagtagacaatagcaactatttatatagcactatttcatatttcagataggatgaagattaaatgcattgtcttatttaatcttcaccataatcctgttgaacagtgtattaattagtattctccagagaaacagaaccaacaggatatgtgtgtatggtgtatgtgtgtgtgtatgcatatatgtacatggagagagagagagagagagatttcaagaaattggctcattagattgtggaggcatggcaagtccaaaaccccatcaggggtaggccggcaggctggagattcagaaggagttacagtttgagtccaaaagcagattgtgagaagaattctttcttgctctatggaggacagtctttgttttaaaaactaaggtcttcaactgattggttgaggaccactcacattatagagagtaatgtgccctatttaaagtacaatgttttaaatgttggtctcatccaaaaaaataccttcacagaaacatctagaataatgtttgaccaaatatctgggcactgtagcccagccaagttgtcacataaaattaaccatcattattcttagtttccccatttgatggaaaataaaactggccttgaacactccaagaattaggattcgaaacaggttatctggattttatgtcccagggctctgtgctagatgttgaagtcccgtctttcttggggttgcaaattcactgcatgagtgaaactcaaatacagtcaaaattaaccttgaaaatccttaaatcacctatagacttgagtatacagtgttgtatatacaatacttgtctgtttctttatttaattcatcagataaagttggttacatttaggaatctttttgttataatttcaacttttattttattttttgaatttttatatatttatttatttatttatttatttatttgagacggagtctcgctttgtcacccaggatggagtgcagtggcacaatcttggctcactgcatcctctgccttccaggttcaagctattcttctgcctcagcctcctgagtagctgggactacaggcacgcaccaccatgcccggctaatttttgtatttttagtagggacagggtttcaccatattggctaggctggtctcgaactcctgacctcatgatccgcccacctcggcctcccaaagtgctgggtttataggtgtgagccaccgtacctggccttatttttaatttttgtaggtacatagtaggcgtatatatttatgggatacattgagatgttttcatacaggcatgcaatgtgaaataatcacattatggagaatggggtatccatccctgcagcatttatcctttgtgttacaaacaatgcaattacactcttttagatattttttaagtgtacaattaagttattattgactctagtcaccctatcatgctatcaaatagtaggtcttatttgttatttccaacttttttttgtttttgagatggagtctctctctgttgcccaggctggagtacagtggtggcttctcagctcactgcaacctccgcctcccagattcaagcaattatcttgcctcagcctcctgagtagctaggactacaggcacatgccaccacgcccagctaattgtttgtatttttagtagagacagggtttcaccatgttggccaggctggtctcaaaatcctgacctcaggtgatctgcccatgtcggcctcccaaagtgctggggattacaggagagagccactgcacccagacaatttctaactattttttcgtacacattcaccatgaccacctcctcctcaacaccccactgcccttcccagcctctggtaaccatccttctactctctatgtccatgagttcaatggtttcgatttttagatcccacaaataaataagaacatgtgatatttgtctttctatacctgacttatttcactgaacataataatctccagttccacccatgttattgcaaatgacaggatctcattctttttatggctgaatagtactccattgtgtatctgtaacacattttctttatccattcatctgttgatgaatacttaggttgcttccaaatcttagctattgtgaatagtgctgcaacaaacatggaagtgcagatatctctttgatatactgatttcctttctttttggtatatacccagcagtgggattgctggatcatatagtagctcaattttcaatttttttgaggaacctccaaattgttctccatagtggctgtactaatttacattcccaccaacagtgcacaagtgttttcttttctccacatcctcaccagcatttattattgcctaactcttggataaaagccattttaaatatctcattgtagttttgatttacatttctctgatgatcactgatgttgagcaccttttcatatacctgtttgccatttgtatgtcttcttctgagaaatgtctattcaaatgttttacccatttttaaattgaattattagacttttttctattgagttgtttgagctcattatatattctggtgattaatctgttgtcagatgggtagtttacaaatattttctcccaatctatgggttgtctcttcactttgttgattgaatcctttgctttgcagaagctttttaattgatgtgatcccatttgttcctgtttgctttggttgcctgtgtttgtggggtattgctcaagaaatttttgcccagaccaatgtcctggagattttcccaaatattttctgcagcagtttcatagtttgaggtcttagatttaactctttaatccattttaatttaatttttgtatatggttagagatagggttctggtttcatttttctgcatatggatatccaggtttcccagcaccatttattgaagagaccacgcattccccaatgtatgttcctggcacctttgtaaaaaatgaattctttgtagatgtatggctttatttctgggttctctattttgttccattgcactgtatgtttgttttcatgccaatacaatgccattttggttactatagctctatagtataacttgaagtcaggtaatgtgattccttcagttttgttctttttgcttaggataacaggctattctcggtatttgtggtttgatataaattttcggatttcgtttttctatttttgtacataatgtctttttttctttttcttttttttttttttgagatgttgtctcactctgttgcccaggccggagtgcagtggcacaatcttggctcattgcaaccttcacctcctggcttccagcaattcttgtgcctcagcctcccaagtagcagggactatgggcatgtgccaccatgcccagctaatttttttttttttttttggcagagacggggtttcaccatgttaaccagactggtcctgaactcctaacctgaagtgatccacccacctctttgtgttcccaaagtgtgtcaacagtgaacaatctgacaaagcaacactttgcttcccaaagtgttgagattacagacatgagccactgcgcccagacaagaatgtcattggtattttgatagggattttattgaatctgtattgtgttttaggtagcattgaagcaggatatttccttgaccccttcgtgggtgggaactggagtgcactggtgctggacctagctggcgctttggcactagcaggggcgaattccactcacttaaacctgctgtgttctaccccttgtgggaggggaatcacaggtcagtgggtgcaggagctggggtgagtgcctttgggcaccggcaggagcaaaactctatgcgcaccccacagcagagtccggggggcggggtgcctgcgacccttgaagccccagaaggagtgttacagtacccttttagctttgctgtttgcagatggcttaagcattaacagctcaccagagggtcagtgtgacagccttctgcacccacactgaagttcttgtctggcatccaggaggaatgaggttacacaatgaatcaaaggtggttaatgtgggagattttattgctgatcaaagtggctatcagtgggagggggagctgaaaaggggatggagtgggaaggtaatcttcccctggattccagctgtccccatctggactcctctccaaagctatgccatcaagctgtccctctgaagtcaagccacttctctccaacatccaactataatctccaacgtttagctgcttctcctctttctgccagctgagcctgggtttttatgggcacaggatagggggcagggtcaaccatgggtggttttggaaaaggcaacattcaagcaggaaaacggaaatataagttctcactttggactgtggttccaggcttcagggtggggccctcaccagggacctgcccacttctgcctagaatttccctgcctcctgtccctgtcagtatggacatttcaacaatattgattcttccaatccatgaacatagaatatttttccattttttgatgtcctcttcaatttctttcttcagtgttttatagttttcattgtagacatctcccacttctttggttaatttgtaggtatttaattttatgtgtggctattgtaaacaggtttacttttttatttctttttcagattgttcactgttgacataaagatgctactgatttgattagtttgattttctatactgcagctttactgaatttgtttatgggttctaatagttttttgtggagtttttaggtttttccaaatataggatcatatcatctgcaaacaaaaataatttgacttctttttttccaatttgaatgccctttatatctttctcttttctgatggctctagccaggacttccaatactatgtggaataacagtgttgacaatgggcatccttgacatgtgccaggtcttagaggaaaggctttcagtttttccccattcgatatgatactagctgtgggtctgttttatatggcttttattatgctgaggtgttacttgtatccccagttttttgaagggatgttgaattttatcaaatgctttttcagcatcaattgaaataatcatggtctttaatccttcattctgttgatattatgtatcacattgattgatttgtgtgttgaactgtctttgcacccagggatcccacttggtcaggatgaaggatctttctaatatattgttgaatttggtttgccagtagcttgttgaggatttttgcatcagtattcatcagagatattggcctgtaattttctttttttgaagtgtctttgtctggttttggtatcagggtaatactggccttgtagaatgagtttggaaatagttcctcctctatttttcagaatagtttcagtagaattggtatgagctcttctttaaatgtttggtagaattcagctgtgaagccatcaggtcctgggcttttctttactaggagactttttattatggcttcaatctcattacttgttattggtctgttcatgttttggatttcatggttcaatcttggtaggttatatgtgtctaggaatttgtccatttttttctagatttttcaattcattgacatgtaattgctcatagtggctactaatgatcctttgaatttctgcaatatcagttgtaatgtctcctttttcatttctgatattatttatttggatcttctctctttttttctcattagcctggctaaaggtatgtcaattttgtttaacttttcaaaaaacaactttttgtttcactgatcttttgtattttatttcaaattcttttaattctcctctcatctttgttatttcttctactaattttggggttggtttgctcttgtttttctatttttttttccaaaagaatatgcaggtatcattgcttttctaggtctttaagatgaattattagattgtctgtttgaagttttttctgtcttctgatgtaggcacttacagctataaaacttccctcttatgactgtttttgctatattccataggttttgatatgttgttttccattatcacttgtttcaagaaatttttcaattttcttcttaatttcttcattgactcactggtcattcaggagcaatttttgttgtagttggtttttttgtttgtttgtgacagagtttcactgttgttgcccagtctggagtgaaatggtgtgatctcagctcactgcaacttctgtcccctgagttcaagtgattttcctgcctcaggctcccaaatagctgggattacaggcatgtgccaccacacctggctaattttgtatttttagtagagacggggtttctccatgttggtcaggctggtctcgaactcccaacctcaggtgatctgtctgcctcggcctcccaaagtgctgggattacaggcgtgagccaccttgcctggcaggagcatattttttaatttccctaattaagttaaagtttaataatattattaaacattaataaattaatgttttataatactactggtgtatggtgtttgtatagtttcctaaattcctcttgttattaatttctagttttattctattgtggtcagagaagatgcttgatgttatttcaggttttctgagtgtcttaaggtgtgttttgtcacctaacgtatagtctgtcactgagaatgatccttgtgctggggaaaacaatgtgtattcttcggccattggatgaaatgttctgtaaatatatattggatccatttggtctatagtgcagattaagtctgatgtttctttgttgagtgtcttcaacttttattttagattcaggggatacatgtgcaggtttgttacatgggtgtattgtgtgatgccgaggtttgggatatggatgatcttgtcaccatggtagtaagcatagtattcaatggtttttcaacccttgttctcctctctccctccttcttctagtagtacccagtgtctatttttgccatctttatgtccatgagtacccaacgtttagctctcataaataagaacatgcagtatttggtttcctgttcctgcattaattcccttaggagaatagcctctagctgtatccatattgctgcaaaagacatgattttgttcttatttatgtctacatagtattccatggtatatctttaccacattttcttgatccattccgccatcgatgggcgcttacgttgatttcatgtctttgctattgtgaataatgctgtgatgaacatataagtgcaggtatatttttggtagaatgatttattttcttttgtatatataccgagtaataggattgctgggtcaaatggtagttctgtattaagttccttgagaaatctaggagtcagttttaaaaattgttctcaatcattgtttggcccatggtgtataaatgaatttgcttaagttgcatatgcatatggatgagaatcctttgtactgttttaatgatatttagccctatttgatgtcccatttaccttaatcgtagcttttgcatttaggaattattagcacatcaaaacttgctaattgttggaaaacttctgcctgttgctagagcttactcatagttaataccaagaggaagctgagtataagtagtattagataaaaatctattgtacttgtaataaaaaatactctatgaaatgtcattgagcgtgcatagctacctttgttgttgttgttgttgttttgagatggagtcttgctctgtcacccaggcttgagtgcagtggtgtgatctcggttcaccgcaagctccgcctcctgcgttcacgccattctcctgcctcagcctcccaagtagctgggaccacaggcgcctgccaccacacctcgctaattttgttttgtactgttagtagagacagggtttcaccatgttagccaggatggtcttgatctcctgacctcgtgatctgccagcctcggcctcccaaagtgctgggattacaggcgtgagccaccgcacctggccaaagctaccttattttgagatctcagtgtacctaagtataattctagaaatgtttttctatgcattctttaggtatactgaacttccagaatttggaggcactttgaaattggttcaatgtgtagaaaagtctggatagtaagggatctaagcactttttttgtttgtttcttggcatttccaggatatcttatttttagaaaagcctgagtgcttgtgatacatggccacagcacactggccatgtctcaggtgacaaggaccaggagtttgtgttctataactacgcaatgctggcatcattctagtgtggagaagcctcctggtttgattcattataggatttgtttatttcaaaagttaggactagtgggtgggtgtgtagctcagggcacacatgctgctctcccttctctaaatttctgtatcaacataccatgcagtgaaagagcatttggttgtcacctgccctttatttttcgtttctgattacttcctacaagtgggatgtcttggtcaaaatgtatgagcagtgttagggttaaattttatcatacatgtctctcctttaccctaatttaatattgttaatatttggcacatattttcacacagcctaattctctctctctctctccccccattttattactattgtaagttgcatcaagaaactttacccctaaattattctgcatgcatcacctacaaataatgacattgtcctacataactacatcagcactgtcacgcccaagaaaatgaacaatatttccatgatactatctaactggctcatacctttcttttttttcctctctttttttaaagctgggctgctttctcagggttcatacatttctgtgccacttttccccacactgttttttctacatggattgtgcctcagtgagctagtatagctcaccaaactctttacttttcttagggttcaaattccaattctacctcttccatgaaacatacatagaaaaccccaactgtctcgaatctctagtgaaatcatgctcctggaacactaaattatctgtattagtcactaatgtggtacctgttctctattgtcaactgctttatgtaaatatctcttgtctccccagtaatattttttgtctcccaaacttcaattatttacttaccactttcacgatttttgccacatccttgccatcaatattatttacatactttaaaattatttaaataaataaataaataaatctatattagttttgtcctaagctatctggagaattctcggtttgatgtgaagtattactttcctagaattgctgaaacaaactaccacaaactaggtgggttaaaacaagagaaatgtgttctctcactgttctggaggccagaaatctgaaatcaagttattgtcagggtcatgctgcctctgaaggctttagtgaagaaacttttccttacctcttccagcttctggtacatataggtattctttggcttgtagccccatcaccccactgtcagcctgcatcttcacattaccttctcctctgtggctctgtgcgttattcctctgtatgtctcttataaggacactagtcattgaatttagggcccacccagataatccagcaggatctcttcaagatctttaattacatctgcaaagatactttttccaaaaagactctgggaattgaggtgtagacgagtgtttttgagggtcaccattcagcccactacaatgtgttatatatattttccaatgtacagtacaatagagtaagcataaatattaaaataaaataacttcatccatgtattacccaaaaacaaccttagattctttgagaaacaaaaactgatttagtatttttcacattttctatagttttgtgctaggtactaagcaaatacctagtgaacaaatatatgcatacatatacatatgtacatacatttgtacatttatgatctcattttgcctgattgtggctactaccatcccaatctcttaaaattgccgggtttgttagattaagtctaggtttctaataatacccatctccatccaccgctccattttctaatacccaaacagataatgctcttattggaaaaagaattgagttttagaaggttaaacagactttttgacctaaacatgaatgtgtacaatacatgtgtgcatatgtatccaggcataaaactaattggtttaacccagagcaaagctggaaggtacctgtttacaaaaacaggtttcctctttctgtttgggaggagcctaggctttatcgtgtttctataacatcccttcctctccttccacctactgtgctgtatatagtattttgttcttcatttctaatcttgcattaccactttcaagctccacatcagagctgtttcaaatacatgaaaaatggaaactttgtaacagttgattccactgattctcagggcctctctacctatcttaatcaaatgcttaaatatttgtgaaattaaccaacttttctcagagtttatttctagaattgagaggggtgtttcctaagaaccgaaagggtctcatctttagtaatatatgaataaataactctttttatatttttttgtccactcaaattggcttaaggaaacctgataaggattctgggtatttgaggagtagcactgtggaaattaaagcttgtcttcaaaccacccctaagtttctttgttttctttcatgcacaaccttcttcatagattcagaaatccggaaattcaggataaagtcttaaaatagcaaatggggaaagtagctattctctttgatagtgattgactagagaacacttaaaaactgaagccatcacaccacactaaaaatgaagaaagattactttaaaagaaaaatctgatgacagaacaatcctcagatgagtttcaaagctgaagtgattatattcaatgaagcatgaaataggtagccatcctgagtcatcttagtgaggattcttaaaatcaccaaaattctagggacaaaaactcactcaatcaagacttgaaggtcttcttcagaaccttcaagcataatatgctatctataaagataaggtaaagcaaatagggtgttggggttttttttaaccatagggagggttatattcaaactatggaataagttagactgtataacaatatttttattaaaattattttgatcatattgaaaaaagaatcctcagtgcacacaaacaaaacttattcaccctgatagtgtgtagatatggaatgcttgtctttaagccacaaaggaaggaacagtaaggtcaaccttgagacctacttttgagaacagtctgttttcttaagaaagcttgcattcagaagacaatatttacacccagaaaatacttgctacaagatagattcacttagacataagaggcatacttgggagtgatatgtacagaaaaaagtatgtgacactatgctttgaggaagttactattaagatactaaaacccaaacaactccccttccaacacttctctcaaagccttttgatggcaggagagaagtaatgattgaagccctgctgcagacagggtttggttaagaattggcaaaccacaaaataggtttagtctatgaaaggacaactaatgatggcctgttggagcaggaccctgtaacactgtatctcatcaaggcaataagaataggctatcagttcttcagtttcttgactttcatcaatcagtttccattttagatgttcctacgtaatgtttttcaataaaatgcatacctgcagatcaagtatcagctaaacacaaggccttgagctagtaacattgttgtaggcagcactcatctcactgaaatggcctttctttggcaaaagagagtaaaagttgccaaagtcgtgtttattttatagttaggattcaaagcttcagctttttcaggtttcttagtccaaaaagtccctaaaatttagctaaatcttttcttaatttcagtggcaagttgtgtttatttatacacctgcacccacaactatattcttacagaaaatgatattacagtgaattattattattattattattatttttgtgtgacagagtctcattctgttgcccaggctggagggcagtgacaatcctcctgcctcaacctccagagtaactgggactacaggtgcatgctaccatacctggctaatttttgcatttttagtagagatggggttttaccatgttggccaggctggtctcgaactcctgacctcaagtgatccacctgccttggcctcccaaagtgctgggattacaggcatgagccaccgcgcccgccctacactgaacctcttcttatgctttctattgtaactctatttctcactgttattgacagcaatgatagactatggaaagagataacattttttcttttgaagattccttggattctatctttttaatctgggaatggagctactcaagtgaagagttatgtgggaaatgtaggaaaaataagagcttaagttgatttgggggattctgagaacaggggagttttatgttcagcagagccaatcttgacaacttcctctccctgtcaacaggattctactccccccttatctggatgggtcaaatccacccatgagggatgggttacatttgcagtatgtgaaacagtgggacaaatcacagaaatcatgtcctggaggagcagattgaagcaatgtttggaccacaaacaagggctgagttgggataggtgctggcaaatcaagaaaccaagagtgttgtagcataaaagaagggaaaagaagatggcagtctggccaaattctggagacaaagcacggatgggtttttggtgccgttactcattcccagcctgctctgagcattgttgtcatgtgtttttgacgcagagtcttgctctgtcacccagactggagtgcagtggtgtgattatagatcactgcagcgctctgagggtttttaaaataaagtcagagcaagaagacactgcctcccctgccacttattgctctctgaattcagacccttattatctctcacctaaattttaaaaaatcataagcataacataattatcacaccttaaaattaactaattcattaatattgtccaatatccagtcaatactcaaatatttttacatgtctcatcgagatttttccacttgctttcttttgaatgtctttgaatctagttttattcctctttcaatcaatcttcattaagaagctagttaaatctcacagaaatagttcttcccttgttactcctctcttccaaacaattatcttctatcacccaacctttcattgaactctacctttcctcatcttccaaatatacaaaactaaaagtggttatgttttatataaaggatgtattccttaacatttttcataatttaaaactcccataattcaagtatcatgctgatagataatggaagcttgtttgtttactggctaaagaggtggtaccaccatctccaaaatcatcttcaagatccagagtgttgcttggcagtggcatacacagttcattatatccttgacctttgaattcatggaattcttagaaagtttttaattaggttgaggctttatttcatatattacatataaatgatcatttattagttttttaaaaaaagtattagttttttattaaaaactattagttttttaaactaataaatgtatttattagttttttaaactaatgtatttattggttttttaaactaataaatgtatttattggttttttaaactaataaatgtatttattggttttttaaactaataaattggttttttaaactaataaatttatttattagtttaaatcatttatgatcatttagatcatttattagttttttttaaaaatcccagaattaaaaagttgcagagttcaattttgcatataatacaactaactgtattgcaagtttatttcatagtttattctataattatactgtctgttgttatggctctatagacaggaatatctttcttatctcttatctgcctagaaaatttctattaattttctatgactcagctgaaatatcacctcctccttgaagccttccctttctagtcagaatgagtcattcccttttgtttttctaaaacgccttgcttgtatgcctgttacattatttattatggtatgatttataaactattcacattattctatcattatatttaatatgttggtatgtacttattggctgtactttattgatgtgtgctgccactgagcttatagtagatgctcagaaagtgttgactttaaataattttgcaagattattgtgaacgttaaatgaaataatttttaacaattgccggatacagtacctggtacttacagatagtaaagtttcccgtctgtttttctctttagtttactcctgccttatttctcccagcaccatgtattccttccatgtgaaatgaatagagatttcttttttacattgcttgcatgtctcttcagggtactaacactgacttatgcatctctcatttgtttatttatttaaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcaggtaagtaacaatattgcctctttcctggccttcctgaatctattcccttttagagtcatcctatctcctgtctcttttcacttcctccaattattcttgcacactgcttcaagagtaatctttcaaaagtactgttttttatgtctttttaatgcttaagaatgtacaatgagtcttgattagaccatgcttctcaaacaagtacaagtatgcatatctatcagtgacatatcaaacaacttcctggaacttccacattatttgatattaaataatttaagcattttatatttaaaatatgattatcttgtattacaaaatgcaaaatttaaaaacctgttaagataaaccacatgcttcaaaaatagttgaagcttactaaaggcatccaccctcggacttttcaggagaatgtgtttattttatgccattcagaatgctttggtgggaaagttgagaacaatatttctatctcaaacatacttagccagtattagctcctgcctctaccaatactttcccttttctcttccctacaaaagaagtaattgaaatattgtcatcttccctgtgttcttcctcatttggcatctatcactttccattttacttatttatttgcctgtatcacaagagtttgggcattattcacaactgaattgtaaattcctgaaaaataatactctatcttaatttttttatgtatgcctccagagaacttaacacagtgctaggagttgtcttgcaacagataatttgatgaacaaacaaacttgaaaatttgtccaagagagaattcaaatgctataatcttccattttattttatttttaaaataagttcagaattcagaaaggtataaattaagtctctcttccaccactatcccccaaccactagttttcctcccagaggtatatctgttttagtttgtaatcaggaatgatcaaggaaaattatgtggcctctaaagcaggctgataatgttttgcataaatcggaaaggccaaggggtggaaatgactaggaagcagatttcagcttactgtaaaagagtatctacccttgaaatttgatgccctgtactaaatgtaggaggctgaaaaacaacatactactaagcatcaagttgctgagactctgcactggtcttctgaatacaaatattattattgactagtggttaattgtggtaatgataagtgttcataatcttattttgagatgtgatatccattccatatatgaagggagagccaaacaaacaaaccaaaaaaaggaaacaaacaaaaaaggaaataaaattcctcgtgtgacagtttatgctgagataaaggcagtggtaacatcaaaggatggtttgaaggagctttgaatagtccccataatatcatcagtccatcagagccactctaaataaacaggataaattttaaatgtgctcaatgtggttccaagctaagggcattggcccaatggtgtctgtattagttcgttttcatgctgctgataaagacatactcgagactgggaagaaaaagaggtttaattggacttacagttccacatagctggggaggcctcagaatcatggtgggaggcaaaaggcacttcttacatggtggcagcaagagaaaaggaagaaagaatagcggaaagccctgataaacccatcagatctcatgagacttattcactatcatgagaatagcaggggaaaactggccaccatgattcaattaactcctcctgggtccctcccacaacatgtggaaattctgagagatacaattcaagttgagatttgggtgggggcacagccaaaccacatcagtatccaaaatggggggcttactaaaccttagggggcacatataaaacaattggagtgcaagaagaaagtatcaaaatttgtattttcttacccttaaaaattgacaggtaatattgtatgttttaatcatctatagcatgatgttttgaagtacatatgcattgtggaatggttaaatctagctaaataataaatgcattacctcattatcatttttgtggtgagagcacttaatgtccattctctttacaattttaataaataaaatgtatcatcattaactatacttgccttgctatacaatagatctcttgaaatgtattcctcctatctagctataattacgtatcctttgaccaatatctccccatccccctccccactagccaccccagcctctggtaactaccattctactctacttgcatgagattaacttttttagattccacatatgagtgagatcatgcactatttgtccttctgtgcctggcatatttcacttaacataatgtcctccaggttcatctatgctctcacaaatggcaggattttattctttgttataactgaataatattatattgtatatatatatatgtcacatttcatttattcattcatttgttgatagatattttaggttggttccacatcttggctgttgtgaataatgctgcactaaacagggatgcagttatcttttgggcatgtgattttatttcctttggatatatacccagaagggagattgccagatcatacggtagttctaattttaagtttttgaggaacctccatactattttccataaaggctataactagtttacattcccatcaacagtgtgtaagtgttcccttttctccacatactcaccagcacttactgtcttttgtcttttcgataatagtcactctaacttaagtgagatgacatactactttttgtttgttttcttataatgtatacaaaattgtaggataccgatacatgtatatcacatacatgcacaaacatgcacacctcaagatacatgcttaaaactttttagtgaatgatatgcaaagtatagagacaactcttttaaccaaatacttgttccccaccttatcaccacccccaagtttcttctctatagaaattttgaaggtttcactggatctaggagactgttgaccacctgattgagtttttaggaattagaaacatcaggggttgataataaggaatatttgacagcttctcccaacataggtggaaaggaaggttgtatcaagcacctactaggtggtaggtatacgtttcatctcattgacttatttctgtttaggagcacaaaggccaaggtggatgttctcacatctggactaatcctagaatttgattttaggacagccaggagctattcagtgagttcaattcaacacacacacacacacacacacgttgaaactaacttttcagctgaccctgtcctggtagctggagatagaaagatgaatcatacccagaccacatcctagagacactctcatttgataccactcatagtggtatcagaactcttcatactactcttactttaaaggcatttctgttccctgctatgcaaaaaaaaaaaataaaatgttattctcttccttccatgcaaatacacttctttcatcttgttttttatttctttatttttctgtcttgctgccacttcttaaggtgggacaaactgggaatcctgaaaatgattaaagaggcacatacatcttcagctcacactgctccctttctttgcttttagtgaaagttgaccccacctccatgtctccactggaaattccaagtgacagtgaggagagtacaattgagagtggatcctcagccttgcagagtctgcagggactacagcaagagtgagtactttttgtcttcaagtctgtctttgtgtatgtgtgtgtgtgtgtgtgtgtgtacatttgcacatatgtataggtggaactaatgatcagacacaagagtaagaatttgaggacaagaaatatagggagactgcctttccagtgaaagtatatgagtttgtgtgcacacatgtgcatgtacatgcatgctatagtagagctatgttctaactgtagatcatcaatttttcttttgaaaaatcttcaaatttcccataaagtgtagttatgtactgtttctctctgtaagtttaaaacagctttgtctttcaatattgaaactaattggaagtagttggcttgtgtttagcaacaactgttgtatgaaaaacaaatttctttaagcaggaaaatgaaacttattgaagtgaaatgctcacactgtttgggaacacaaccactgaaggaaacactaccacctcccatgctttctctgagcacctactgagggacctgtacctactgagcagaatggcctagttgacagaattgtttttactattccaattatttctttttggggggacctagcattaaattcacgtaaattaaaagccgatatgatgtggcaccaatgaatgtaaattcatttttttagccttcactttaaagtcactgtttggctttatctctatttctttgatcagaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggtctgcccactcccatctcacccccaacacacacacacacacacacacacacacacacacgagagagagagagagagaggggcagagagagagagagagaggggcagagagagagagagaaaatttctgagagacagagaatgaagtcctgaaacaaagactgatgcatttatactcatgggcacaggctccattcatggtttttatccctatttcttgtccctactctaaggcagattttataaaactggcctaggaaaacactaaactaaatctggtgtcttaatagtcatcattcccagtgagccctgtgggtctttctaattgcggagtcaacacttaagcaaagattaaggcattactcccttccttactaccagggtctcacaagttttactaagcatggaaaagcacaagaacaatttaaactatgtgaaattaaagcaggttgtaatccactaaccattaacgtgtctttgttcacattaaaaaaaaaaggtgcacataaataaataaagcagacctggtagtgatcctgtcaaaccgaacagcacatacctgatctgaagaaggagagctgccactcaaatccatgtagtcagccatcaatattcttaggttccacatccgtggattcaaccaaccacaaatcaaaaatattttttaaacaacaaaaataacaatacaacaataaaaaaatacaaattttaaaatacagtataacaactacttacatagcatttacatggtattaggtaacgtaagtacatctagagatgacttaaaatataggagagaatgtgtatagattatatgcaaatgctatgttattttatatcagggacttaagcatccatgaatttcgttatccacccgatgggtggggttgggaatgtaggtggctctgaaatcaatcccccatggatactgagggacgactgtattagtaaatttaattgttaaagaaaagcaaaaaaaaaaaatccagattattatgtgaaatgtccttgattttgaatgttggcttctagttcaaaaattttttataaccccaggaattcaaagaaacctgcctagaagccagatgcagcttgtcatttatcaatgtgtgccctttgccttggagactccttctccatagtggtctccaagctcagaattgggacttagacaccttggacaaggaggaagccctcctttcttgtaaacatctgctatgttacctttgctgtgttagaatttgtgtagaaggacccagagccctagttgttttgcctagaggctatgaacaggtgagtgatttccaggctgcattattcaaacattcccatgacactattattatttagtgatgtatttgtttgcttctcttccatgggagatggatgctgactatatatatattccatatattccaagtctccaattaagctgctgtgggatctgatatgtcttcctacctctttgatcttaggttcctcaaccgtaagatgaggggtttggactaggtaatcccacttgactattttaatctggaactctatggattgaatttcaatgtaacctattgtgcggctaccttctaggaggtcccaagtgtaggcaggttggaaattactttatgatatactaaaagtctggctgtctttcctatgtcacctctcgactcttaaactgagataacagatacaatttacttttatttacttttcggatttcagtactgtttttctccctagtggtgtaagcttcccatatgaagggaaaaaatggccctaaaatatccacaattcttagctttgagtgttataggtgaatgccttacctgataagagatcatgacagccagatgactgatgaatggagacaactgatgtctacatgaatctcactacatttttttttttgagacagttttgctctgttgcccaggctggagtttagcctggcgtgatctcggatcactgcaacctctgcctcctgggttcaagcgattctcatgtctcagccacccgagtagctgggattacaggcatgtgccaccttgcccagctaatttttctatttttagtagagatggggttccaccatgttggccaggctggtttcaaactcctgacttcaagtcatctgcctgcctggacctcccagagtgttgggattacagacgtgagtcactgcccctaacctcactttgtttagattcggaattgttcttattctactcagtttttaggattgacccatacctttgccatgggtatgtgaccataggaatactcacttgaaggcatttcacagaaacatttaatttgccccaactgcttgacttacaataggcttagttgctttaggaaataacgtggcatttctgtaagtgccctcattcctgcagtattgtaataggcctttcctcactacaattcattctccacacagtagccagaggattttcatctgtttgcttttgttttgttttgtttaaatataaataagattatataacatctgctacttaaaatcttccaaggacttcccatcacactctgaatgaaatccaaatagagtatcctaaaaggccctacaggatcttgcctcttattaattttatctcatgacatttcttatccttttgatcccaatttgaatgtcttctgcccagaaaaatcttccctaaacctatcttaagcagtgtccactctcaaatatctgtataagaaaaccctacttaatttcttgatagagttttcttttctttcttttaaaatttttaataatacatattttaacccagtgtatcacaaatactatcactttacaacctaatcagtacgaacaattatttttattttattctcatattttgtgggtacgtagtaggtttatatatttatgagttacatgagatattttgatacaggaatgcaatgtgtaatagtcaaatcagagtaaaggggtatatctgtcccctcaagcatggggcatcctttgtgttacaaacaagctaattatactcttttagttattttaaaatgtacaattaaatgattttttttttactataatgaagctgttgtgctatcaaatgttaggccttattcattctctctattttttgtacccattaaccatccccactgccccccgacccactgacatcccaccatccttccctgcctctggtaaccatccttttacctctatctatgtaagttcaattattttaatttttagctaccacaaataagtgacaacatgtgaagtttgtcattttgtgcctggcttatttcacttaacataatgacctccagttttatccatattgttgcaaatgataggatctcattctccatgtgtgacctttgccttggagactcctccttagtggtctccaagctcagaattgggacttagacaccttagacaaagaggaagccctcctttcttgtaaacatctgctatgttacatttgctgtgtgagaatttgtgtagaaggacccagagccctagttgttttgcccagaggctatgaacaggtgagtgataaatgtctttttagctcttttgcccatatgcaccacattttctttatccattcatctgttgatggacaccagttacttccaaattctggctattgtgaatactgctgcaataaacatgagagtgcagatatctcattgatatactgatttcctttcttttggatatataaccagcagtgggattactggatcttatgatagccctactttgttttctgagaaacctccaaattgttctctatagtgattgtactaatttatattcccaccaacagtatatgagggttcctttttttccacattctcaccagcatttgttattacctgtattttggataaaagccattttaactgaggtgagatgttatctcattgtagttttgatttacgtttctccgattatcagtgatgttgagcaccttttcatatgcctgtttatcttcttttgataaatgtcttttcagcttttttgcccatttttaaattggattattagatttttctcctatagagttttttgaactctttgtatgttctgattatgaatcccttgttgatgggtagtttgcaggtattttctcccattctgtgagttgtctcttcactttgttgattgtttcctttgctgtgcagaagatttttttaactttatggcaccccatttgtccatttttgcttttattgcctatgcttgtggggtattgctcaacaaatctttgcccagttcaatgtcctggagactttccccaatattttcttgtaatagtttcagatcttagacataagcctttaatccattttgatttgatgtttgtatatggtgagatatagggttctagtttattcttttacctgtgatatccagttttcccagcaccctttattgaagagacagtccattccccaatgtatgatctcagcacctgtgtctaaaatgagttcactataaatgcatagatttatctctgggttctctattctgttccactgatcagtgtgtctgttatatgccagcagcacactattttgattactatacctctgtagtataatgtaaagtcacataatgtgattccttcagttttattatttttgcttaagatagctttggttattctgggtttttgtggttccatgtaaattttggggttttttttctatttatgcagaggattgtcgttaatattttgatagagattgcattaatattgtagattgctttgagtagtacaaacattttaacaaaatgtattccaccaatccatgaacacggaatatctttcctttcgtttctgtcttcagtttctatcatcaatgttttatagtatatattgtagagatcatttattttcttgtttatgttaattcctaggtatttcattttatttggagccattgtaaatgagattatttcttgatttatttttcagaatgttcatctgttggcatgtagaaatgttttggattttgtatgtcagttttttatcctataactttactaattttttttaatcaattctaatagctctttttctggaggctttaggtttttccaaatataagattatgtcttctgcaaacaaggataatttgtctttttcctttccaatttggatgccctttaattcttttctcatctgactcctctaggtaggacttcctgtaccatgttgaataaaggtgaaattgggcctccttgtcatgttcccaatcttagaggaaagtatttcagtttttccccatttagtatgatacttatgggtcagtaattaatgacttttattatgttgaagtatgtttctcctacacccagtcttctgaggatttttattatgaaaagatgttgaattttatcaaatactttttcagcatcaattgaagtgaccaaatggtttttatctttcattctgttgatatgatgtatcacattaattgatttgcatatgctgaaccatccccacatctgtgggataaatcccatttggacatgatgaattatctttttaatgtgttgctagtattttgttgaggatttttgcatcaatattcatcagtgatattggcctatggttttcattttttgatgtgtctttgtctggttttggtatcagggtaatactggcctcatagaatgagtttggagtatttcttcctgttctatttttcaaaatagtttcagtagaattgatatgagctaatctttaaatatttgttagaattcgacagtgaagccatcaggtcctgggctttccttcctgggagacctgccccccgcccccgcacctcgcccccgaaaccaagtctcactctgttgcccaggctgtagtgcagtggcatgatctcagctcactgcaacctccaccttctgggagagttttaattatggcttttgtctcattacttgttggttagtctgttcaggttttggatttcttcctgattctgtgtttttccttgtccttaatattaccagtgagttgtgtaccttcagatgatttcttattgctcattaatgtccttttctttctgattgaagtactccctttagcatttcttgtaggatgagcatggtattgatgaaatccctcagcttttgttcatctgggaaagtctttatttctccttcatgtttgaaggatattttcaccagatatactattctagggcaaaagtttttttcccttcagcatcttaaatatgtcatgccactctctactggcctttaaggtttctactaaaaagtctcgtcaaagatattggaactccagtgtatgttatttctttcttttctcttgcttcttttaggatcctttctttatccttgacctttgggagtttaattattaaatgctttgaggtggtcttctttgggttaaatttgcttggtgttctataaccttcttgtacttggatattgatatctttccctaggttgggaagttctgtgttattatccctttgaatatttctacccctatctctttatctacttgctctttaaggccaataactcttagatttgcctttttgaggctattttctagatcctatagttgttgcttcattgttttttattcttttgtctcctctctatgcattttcaaataggctgtcttcaagctcactaattttttcttctgctttattctatttaattgtttcaatctcttagttaacttacgggattctgaattccttctctgtattatcttgaatttctttgagtctcctcaaaacatattttgaattctctttctgaatggtcacatatctctccaggattggtccctggtgccttatgtggttcatttggtttggtcatgttttcctggatcgtcttgatgcttgtagatattcattagcgtctgggcattgaagagttaggtatttattgtagtcttcacagtctgggttggtttgtatccatccttctcaggaagtctttccacatattcaaagggattgggtgttgtgatctaagccatctctgcattaggggacaccccaagcccagaagccctatggttcttgcagacttgtagaggttccactttgatgttcttgaataagatccagaagaattttctggattaccaagcagaaactcttgttcttttcttttactttatcccagacaaacagtctctctctctgttctgagccacctagacctgagagtgggttgacacaagcatccctgtggccaccaccactcggacgtgctaggtcaggccttaaactaatacagcactggatttcagccaagaaccgctgtaaccactacctggctattgccagtgttcactcaaggccctgggtctctacaatcacctgttggtgaagcaagccgtacttatgtcttttccttcagggcagtgagttctcctaggcccttggtaggtccagagatgccatctggaagccaggaactctagtcaaaacttagaagtccacctggtgatctattgtactgtggctgaattggcactcaaaccatgagacacagttcttcctagtcttcccttcactttccacagccagaggagcctcaccccttggctaccactaccataggcttacagggagtacttccaggctactgctgatgttcccataaggcccaaggcctctttattcagcttatcgtgaatgctgcttggcctgggactcacgcttgagggcagtgggctcccctctggccctgggcagatccagaaatgccatgcaagagcataatcctggaactggagaccccaatatcctgcttgtgctctatccttctgtggccaattggtatctaaggcacaagacaaagtcccctttacttttctttccacctttcctcagctggagtgtctccccatagccatcacagcttgggaatgtgctgagtctcatctgaagccagcaagtctcagagtctcatcctaggcccatggtgtactacctaagttttgctactggttattcggggaccaagggctctttagtcagtaggtgatgcgtcctgccagaactgggttcttctcttcaaggcaacagcttcccctgtggcccagggtgtgtctagaaatgtcatccatgagctaggtcctggaaaagaagcctcacgactctgaatgatgccctatcctactgtggctaagcttgtatccaagatgcaaaacaaagtcctttttactctgccctcacctctcctcaagtggaaggaaggggtctcttttgaagctgtgagctgtgcatcctagggttggggaaggggtggtgcaaccactgccttatctgatccagctgatatcttaatatatcatatgctccccgcaagtccactggctctgagcccagttcatcactaggactcacctaagacttgaagtccttgtggcctatactgcctttcaagttaattcaaggccccagagcactttatctcatagtggtgagtcttcccagaattcaagttctgacttctgggatgggcgattcccttctggctctgactggtttaaatattccctccatgggtgggagtcagcagagttcagcatagttttgctttctgctgtgacaaggcagcactgaatttaatgcagtgtctcacaagtgctgtactatccctgtctgaagcacacagattctctctccacaccatgtaggcactgcagaaggatgggtgaggggtggtgttggtgattcaagactctttcctatcctctttcagtgcttcttttaacaatatgaagttaaaaccaggtactgtgagtggtcatctgatttttcgttctttttttttattattatactttaagtttagggtacatgtttacaactttcattcttatgaaggtccttttttgtgtagatagttgtgaaattggtgttcttgttggggcatgattggtagaacattctatttggcccccttgctctgcccctcttctccatttatttttcaattgtataagtttaaagggtacaagtgcagttttgttacatggatatgatacatagtgatgaagtctgaacttttagtgtaactaaggaagttttttaaagtagggagaataacgatcatatgagaaggagcaagctatgtaaaaagcgtggcaaaagactattcttggctagtcagagtacaaaactagtgagatgggaataagcttgccttgttctaataactgatactagttcagcttagctaggacatattgagcgcagcagtgggtggagaaagcattgaggtgcaagagtggaaggggtaagatcagttaagaggctaatgaagcaatccaggcaaaaaatgatgacagctcaactagtatgttgccagtggagatggagagaaggaggtacattgatgattaagtggatgttggtgactctaaggtttctgttttgggtgactgggtgaatggaggtgccatttatagagctagagaatttgccaatagttacacaggtagtaaatgggtaaagccccataggattagacatttgtacctaacctaggtatacttttctctattgctagtattccacaggttccctgggactgaggcagcgacagaaatgcctgattcattgccctccaaagattgtgattcattgttaagggtcctagagagtgccgtctctgtctttggtagatattcttccagcagagagccataagactctttgcttatctgcaaagaccaggcatgcagtgcagcacttcatctcccctgagtttgcaatcatacaaagcaggaaacacagatataacagttcttgttaaacatactgtgttcatactgtcaagtcccagtatatttacaatggcatcacccattttcccaggctccaaatgtatcattgattcttaccattatctttttttttccccaagtcagagtctcactctgtttccaatgctggagtgcagtagcacaatctcgactcactgcagccttgctctcccaggctcaagcaattctcccaccttaacctctggagtagctgggactacaggcacatgccaccacacctggctaattttgtttatttttttgtagaaatgaggtctcactatgttgcccaggttggtctcgaacttctggactcaagtgatcctcccgcctcagcttcccaaagtggttgggattataggcatgagccattaatattctcttatgtcttgagttatttgtatttaaagttctattatttctttctaattttgaatagcctttttattcataatggctaagactatgtattgtgaaactagtgtcttgatttgacatctcaatcagctactcactgctgaaagttgcttcgcccctctttacctaaatttcccaatcttggaattttaatagtgtaaaatacttaaaatagtatccagcatatagtgaatactcaataaatgctaggttttattaatgtttttctttcaattccaatctcgctgtcacctccttaggttttgttcttatatttattattgattccttcatcaattcaatgaaaaattaatttgagctttatatgccagacaaatagattaccccagtaggctcctagtcattgtagtccaccttatacagcatgggtaaataattttaatgtacaactttgaccaagtcattcttgagttaaacagactaacttttagactaacttttagtctgttttattattgttttaaagttctctattgtcaatgcatccccattattgctcacacctaggacagactgctctcacacacacccccttgggtatatcattgccttttatgcttaagtccaaattctctttttaaaaataatcccaagtttttcatctgtcttttataataaggatcatctcataatactcttgtaaggatgttccatgctccaagacagctgaccctatatgtaccattcactgcactgccttgccaagaccttgccaccagctgcctgggttgctttcttcatctaaaacctgcccatacctccatatttgtgccttcacagtaacccagaggttattagctagccttggaacttatatcacacttacttatttttttgaaacagagtcttgctctgtcgcccaggctggagtgcagtggtgtgatctcagctcactgcaacctctgcctcccgggttcaagcaattctcatgcctcagcctcccaagtagcgggactacaggtgtgcaccatcacacccggctaatttttgtgtttttagtagagacggggtttcactatgttggccaggctggtctcgaactcctgacctcaagtgatccatgtgcctcagcctcccaaagtgctgggattacaggcatgagccaccgcacctgccatgtcacacttactatctttgtcacatagttaatatatgtgctttatattatgaattctttctctgcatatatactttgttctttaattcaaatgataagttgatggagattacaagttgtgttgtatgatgttcattggcacaaacaggagcttgttcaatgataatacaagggtaaatgcttttgaaataggaaaatgggcctcactgctgaattcctttacaataatttgtgtgttctagaaatgagctctgatcaccacagggtgtcactgccttacaagtcaaattttcctcaattggttgaggtgtatataggaattctcagaagacattcttgagagatcacaacaaaatgtatagatagcaatgcagccattgggagatgtggagatgctataaaatcacatagaacaaaaagtgaaaatttaatttacacactctaaacatcccctgaaatcctattcttcttccctctgttaacaatttgttgtatagccttccagatctttcctccttggagagagagagacagagaaggacaggcacaagatttagaaaacataaatgagatcctactctccgtgagcatgtgtgtgtgtggttgttcagtatcttttttaatttgataacatttcatttgccatcttttttgtctcattacatccagctttatctcattcttcttagcagctaatgcagctatttctgaatattgaaatgatcagtaattgatgtctttaatctttgaaatgtttgccttgatatagtccaaagctgtgattcagactggatttcattctgttgctcattatgtgaacactatacagttaattagcaaacacttgggagggttggtaggtggtgtgtagtaagttggaaaacagtttatgcaagccagattgccaccagaatttagaacagcataaaattaaatgccctaggtaatttacagggagtaaaggggaaaagaccgagagaaagagactgttagaataccaatgcatttttgtgtctgcattattgtttgtttctgattgtaaaataatacatgctcattgtagaagatgggaaacagaaaaatgtattaagaagaaagcaaacattaccctaatcctacaacccagacttatccacagttaatatttattgttgctcatatagcttatttcctttttcaaaatttttattatatgatacaacattatgattttaaagcatttaaaacagtacaaaagggtataaagtaaaaatgaaaagttctcttcccaccatccctggtcctcactttccacaaagtcattcactgttaacagtttctctcataatgtacatttaagtgtattgatattggctttattatgagtatacaaatgtatggtgtgtgatctatataccataatggggtcatactgcgttaatttttttatactactttttttccatttagctttctatcttgagcatacatatcctatatataattcaaatacaacccaaagattctgggcatggagctatttcaaaaagtttgacctgacactgccccccatgccattacatgcccttgagtttctaaccttacacaaaagacctgtagccttagctgagggccctttccaatgaatcacacattcatcctgtgtatatatggctctattttattttattttatttatttttttgagacaggtctcgctctctcctaggctggagtgcagtggcgcaatctcggctcactgcaagctccgcttcccgggttcacgccattctcctgcctcagcctcctgggtagctggaactacaggcgccctccacgacgcccagcttatttttttcatttttagtagagacggggtttcaccgtgttagccaggatgttctcaatatactgatctcatgatccgtccgcctctgcctctcaaagtgctgggattacaggcgtgagccaccgcaccggaccatatggctctattttagactgtttggtaggagatattagaggaacggatattataaagtgccaaagacctgagtttagatcccagttgtattggttgctagctatcttttaaaaataaaatgttttgaacaactttgtgatatatttttatcctttagagatgagaaaacagagaccaagccagggagaagtgattatataagatcacacagctagtttgtagtagagccggatcacacaaaggcctatttgaacaagaggctatgtgcttcccactctaacatcttggactttctttagaactcctgtaggtaacaatgtattgtattattgaaaatcaatgagagagtagatttcaagtgttcttaccacaaaaaaagataagtatataggtaatatgtatgttaattaactcgacttagccattccacaatgtatatacatctcaaaacatcatgttgtacatttatacagtgcttctcaatcaattaattaacttaaaagatttacaggcatatgccttcaaggttattgcctagccttttcactaaagccttgatacgagttatgtattctattatctttctagtatccgatcatcctctctctgattctcttttttttgtcacattccctttttaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacttctccactgtccagacccgtttttttcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaagtttggttttcagacagtgctggtgcttctgcttcttaagttcatcaagggaatgaggagttcttgtccttctcctcctcttttttttcttttccactttctccttcaggattaaagattttgctgcacaattgttatttgttaggttaaatttggacaaatattcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatattattaa

SEQ ID NO: 5693 - DNA, 55410 bp, human
ctctacccactcaggttgcccagagagcactttaggttctgactcgcgtggggcgcgaggtaccccgtggggcagctaggtgcctccaagaaaccccgccccagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtggtatctcctcgtgggttcctgtcttgaaggatttcttctccgcctcaactttatgttcaagtagcgctttgggggttgggttggttttcatagcccccacccccggccctctccttttaaagggtgtgtggagttcagaggatgggtggagagcgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcggtaagtgactctgggactaatacccacccactcccacctctttcgtctagattctatccccctcccagtccccctgctccccccacacaccccacttggggtttcagcagtgggggcgggagcggaaggttaagaacactatgtggaatcaaatgaaactcaagggaaaatgactttgctaaagggctgggcaaagaaaggccaagaaggagaggagagagcttggtggaagaagtgaaagggggcaagaatggatggatttgtctagtctagtctcccctggctcggcactcccaatactccttaagcggtaaggattgtctttgacttaaccccacacagccaaagtcacaaccagagagaacaggattcacaaggccaaagctcccaggtaaccccctgaagccatagcgggtacctagagaagcttctgaaaagaaggaggaggggacagtggtttaaggtgcaaagttaggctattggaggcacagagtgaggcctggaagcagctgcgggggaggagctgctttgggcgtgccagctctttaaggaggggctgagcttggttggagaaggaagccagagcctaggctctgctccggccctttaagacgtggccaaggcagttggttcgtctgtgtaggtggaagactgactgggccgagttgctgtgattgctgaagtgaatccatttgtttagccacttggcggagctgtctttttgtgggcttttttttttaaccctaagaatttgggaaaaaataaatcacatccaaacaggtggccaaaggcaccatgtcttatttcttttggtattatattcatcgtgaagaaacgcatttattaagcacctgtcacccagtgtggtaataattgagcaaaaagaataatctttaaatttggatttgaaactgatggagattgccatggtttggggtaatctgctttgaaaccctagtatcaccacttattagctgcatcaccctgggccttgcttttctcttccatagaatgcagattaataattctatctcagtagatactcgggtggatgaaatatcttgtgtatgtggcagaggctgccacttgtatcttagttcaacttcccttttctactcagtttggaactatttttctggaccactgctgataaaattagtgtttttctgtccttaaaacaccttccagatgtggtaaaacgaaacttaggaagactgaattagtttgtccaaaggctgaggctagaacacaggttttatttgcttctgatttaacattgtttccaccagacttcatcacttctgaaagaaagggctactagcctgccttttctctcattctttgggcaacttaaccagaatgatataaccaacaggacttttggacaacagaaacaagtgataggtaaatgacctcatcccattcttcagagttatggggaagcccttgagagttgttgacctttggtgactgctggggacacagagaatgggtggggagcaatgtcttcaggtaagcctggagggcagacaggcagaaaacataggaagagtagaaataataacctcaaaagtaaaaatgacaggtgcatctatgtagtccaccctcaagaccaacttacttaatggctgtaccttcagagccctcaggagctatacatccctcttgtttagacttttcagggcacattggaaattgggaaaaaaataaccatgtagcagactaccatcaccactctcattgttctaatacatgcatttctgaggtggggttctcattggctaagtgaattccaataaccaaagtagcaaacagagcctagtcatttttgatcttgccagattgtctgtgcctggtgcggtgggggcagtatatgatcttctaagatctagctttacaatgccatgattttgtgaatgaaggaaaacttaattaggatgattgacatagatgatcatctagtatgattaccatcttattgttaagtagagtatgaataagggaataacattgtagtattgggctcatttgtttattcaaagacagtgtgagatcatgtttggtattcttcctgatttttttttttttttttgacacggtgtttcgcccttgttgcccaggctggagtgcaatggcgtgatctcggcttgccgcaaccttcgcctcccaggttcaagtgattctcctgcctcagcctcctgagtagctgggattacaggcatgcaccaccatacctggctaattttgtatttttagtggagacggggtttctccatgttggtcaggctggtctcgaactcccaacctcaggtgatccatccacctcagcctcccaaagtgctgggattacaggcatgagccacgtgcccaacctcttcctgatttttatatgctaatgtttactatcctcaactgagtttcatcatttagcctgtttcctcatctctaaaatgacatgataatttgtgattataaataatgtaaggaaagcattgaactcagtgcctgatatctaatatgtttcataagttgcggtctcatcatttttgttatttaaaaaaatttgttttatttaaatgctgctgtgtgtttgcagaagtggaatgtagattagtggacaggaagctggatttaaatatatgaaaggtgctagatgttctgtataatatactaaaagatgttatttgtgtatttagacaaaatagatgtgatgtgggcaaactaagctctaggattattaaggagcaataacctaactcaagagcccaatccagatatttcaaatcactagcaatttgacattttgttgtaacctcacactcaccatttctaatatacagcccatcatcacctctggactcttcactcattcctcattcaagactcttcctttcacttccctggttctgcaacttactatgaccatagtaatggtgaacttatttaaactctgtactttagttgtcatatctgtgcattggggataataatagacactacctcataaggttgctgtgaggaataagtgtgttaattttgtaaacacttagaaggcggcatgaaagtgaagcagtgggaaaatgtagctgttgtggtactcatgtccctttcccctcttcctcattttctcatttaattagatgccaatggctgttgtattttttcccctttgtatctggtatctgtttctttattattattctaactgccaccaccttaatttaggcgagacgtgcaaacaattagcctacagaccaactaaagctcacacgtgttttgttttccctaaaatttaaaaactttcaactaaaacatgcattttcaattggtaatgcattccgcctggctcaaaattcagtatttactaaagggtgcatggtgaaaaaagtctccctcctattcctgttctctagccacccattttgcctcgctggaggcaactaatgttatctatttattaggaatctctccagggatatttagtgtatatcaagcaatgagtatgtttgtgtgtgtgtgtgtgtgtgtgtgtgtgtgtgaataacattgtagtattgggctcatttgtttactcaaagataatgtgaaatcatgtttggttttctatagatagatagatggatatatatatatatatatatatggttcagtatcttctgattattcaaaagaaactggaattctaggaatttaagtgaaatctgattttgaaatactggttatcaatcaacttttaaaagtgtgggactaggcaacttgacatactgacatgaactgaattgtgacccccccatcccccccaaaaaaattcatacattgaagacctaatacctaagcttgtgactgtatttggagatagggcctttaggaaagaaattaaggttagatgagctcatattatatataatacatatataatattagtatatatgtaagtaccacaacaactatattttctcactgcttacttcactttcatgccttcttctaagtgtttacaaaattaacacacttattcttcactgcaaccttatgaggtagtttctattatatatatatgtgtgtgtgtgtgtgtgtttgtgtgtgtgtgtgtatatatatatccccttcaccttttatacacagatagtaacacattctgcatattgttctctacaacttgcttgtctacttaaaaatatactttggagatattttcatatatgcacattttttaaatgcctcattcttttttatgactgcataggtttttactatatgcatgagccacaaatttttaaacagttttctgttgattgatctttaagttatttccaaacttttgcagtgttatttgtaataacaataaaaacttttgtaagcagtgcattagagagctcaggctgccataacaaaataccattgactgagtggcttaaacaacagaaatgtattttctcacagttctggaggctgggagtccatgatcagggtgccaacatggtcagattttcatgaggactctctttctgacctgtagaaggccaccttttcactttgtactcatgtgatctttgtacaaatgggaggagaaagagtgaattctctctggtgtgtcttcttagaaagacactaatcctatcagatcagaacctcacctttatgagctcatttaaccttaatttctttcctaaaggccctatcttcaaatatagtcactaggttaggtcttctacctattaatttttttttggagagtggacacaacacaagtcagttcatagcagtgtgtcaaattgcctagtcccacacttttaaaagttggttgattgccaatatttcaaaatcagatttcccttaaaattctagaattctaggccgggcgcagtggctcatgcctgtaatcccaggactttgggaggccaaagcaggaggatcacctgtcagcagttcgaaaccagcttgaccaacatggtaaaaccccatctatattaaaaatacaaaattagccgggtgtggtggtgcatgcctgtaatcccagctactcaggaacctgagacaggagaatcgattggacctgggaggcggaggttgcagtgagccgagatcacaccattgcactccagcttgggcaacaagagtgaaactccgtctcaaaagaaaacaaaaattcttcaattccagtttcttttgactaatcagaagatactgaaccagcattctctcttggcaataattgcctagagttgatgagcctctccctccctcccctttaaaacagtacttgtattttttgttcaccacattactcatctggcctaggtggccttaacctgtctgacccctagtctagatattgagattatggcacctatgtaagctcttaccgcagtactcatagaatattccaatagcttctagttctactttgattctttctgccctctctactctgaggaccactgcaaggatatattccttaaaacacttttaaaaattatgttactctccttcactccacagtcatttactgggtgtctacaaagttggaagcatcatgctagaagctgaggtgatagtggtaaacttaccactttaggttaggtaaactatcagtttaggtgggacccttgccttcatggagtatgcagtttacttttcctctcgtctggatttcctttctgtttcttcttgactgtcgtagttcttcaaagcccacctcaaagcaaaccatttatttgaaattttctctgactattccattctcagtaatctcctcctctcccaattattgctcatagcctcaaatcataatccagcaatgcagcatctattatcttgtaatatttgattgctattattttatgcataattgtttctcatcacacggacctgggatctcaaacttaaatctccagggcccagtaaaatgagaaaagcatgccctgtctaaaggggacagctgttgatcatctccagctaatttttcccttgtgccaatgtacactctgtattataaaatctctcagcttttttagaaaagcaagaaataggatttttttcttaaaacatgaaatctgcatttgaaaggttgttagatgtttctgttttaatctttaacatcactatgagaaccaggccaacatctgcagtgggctgccagttttctctatctgacctagactgcaaatttactgaggatagaggccagagaccatgaagttttcttccttctggtattacctcctccctccttcccacataatatctactacagtgttgactatttagtagggtcttggtaaagacttgattatcatcagaaagttcccctttaagttaaccatgatgtcctgtaaatgacatagtagttctactttctccaaatacctaaatgtgcctttgaagacaattatcaggccagctttctttttccctgtccccctttttgccagatgtaatcatctacatttcttgatctagctccattttgttttcttttaaaaaaattggttatttctctagtttctttcatttttttctgcatttctcttctatttgccatttttcttgaaatattgtacatcacaaataaagtacagtatcttcagaaaggtctacatgatgctgagcatatatttaagtttgattatttggagctaattattccatctcttgtttcttcctatacgttcaatgatgcggttgtttcatcttcagttagaatgggcggggatgtgatgtgaatatatttatttcttgtttgttaaactagttctgataaatatacataacagttggtgctaaaagaataataacatacttattccttaattttgtagctagatcctagaatagatgtgtagcgttgaattggctactgcattaacctcactttctggagctctacaaactgaaatggtccaagactcttctaggatgccttgtcttggtgctcctgagccactgctcaggcagtgagtagaaaagttattcaagagccaaggtctcttcccttaagtacctgttgcacaaaacatggatgaggaccaattgtattgttacaaattatttgtggttgccacactaccaccatgtttaatttattggaggagattgttgcatgaaataaaggtatgaagtaatgaagaggatcacatgagatgttacataatgattcagagcaatgagtttttgctgctgtggctctttgtcccttagtgccatgctggagttgtaattcctagaggttttgttttataattaacataataattagtgggaatcttttaatactctgtacatatattcaatattagagtttgctgcaaagatataaaaacaccttcattattattattttcaactctaacaaactatttcaaagtacagggtagtagcaagtactttaaggaaaaaaaaagagctttggtatcaaacatcatacctggattccaatcccagctcaataatttaccagtttatgtgaccttgggattatttaatcccattgactctatttcttcatgtgtatagtgggatcaacagtaatacctacctcacagggcaattgtgaaaattaaatatgtcccattagaaatgccatgaagtgtggcacacgtttacctatgtaacaaacctgcacgtcctgcacatgtacctcaaactttaaaattaaaaaaagaaatgccatgaaatgatatatctgggatttgcataaaaatatacattgaggtagggggagtgggttgaggtacagatgaaacaaggtttaccattagctgaaaatcattgaatctgagagtaggcgcatggggtttttgtctacttttgtatgcatttaaaatcacccataatttttttttgagatggagcctcgctctttcatgcagagtggagtgcaatggcatgatctcagttcactgcaacttccacctcctgagttaaagtgactcgtgcctcagcctaccaagtggctgggactacaggcatgtgccaccacacctggctaatttttgtattttttagtagagatggcatttcaccatgttggtcaggctggtctcaaactcctgacttcaagtgatccacccgccttggcctcccaaagtgctaggactacaggcatgagccaccgcacccagtcattcatagtaattttttaaatgccattggaatgagactcaagtttacctgatggtttgtagaaaacttaatccttcttgacatcaatctcacaggttaagcagaaacctgagatgattattatggattttccatctatgtccttgtaataaaatcatatatcatagaatgttataaactggaagggatctgaaaaggactaagtagtttactcaaaatgacactgctagacaacagtgaagcctgatctagaatacaagtctcccagatcctagttaaatgattttcccattgtttcacatggccttctttaatagtaagagttttatctgcttattgcatataagattaattattgtctaaacataaatatatttgttcaatggagattcaaggcaaggggactggttctaggcatctgagattatgtttctataatacctttaaatctgttttgtcaattgattcttacaagtatcttgtgaggtgaatgaggagttatttccactttctacataaagtgacgagacttgctcaaggtcacacaacaatttactgattaaactagaactaaaatgcaggcctggagtttattgagcttcatctccacttgtatttccagttttagacttttatcataattcctcttagctttcatctttttccagaatgaggaatcttaatctctagcacattccaaggtaatttttcattctggcgtatttattttctttttgtggaaaagaaaatgtagcttaacatcagcgtctgagagaagcgcaactggctgaaagcactggaggctatgcaggtgatattgtagaacatgaactcataggagaatggagataaagatatcaaaaatcatacataagtttgttactggaaatggtttacatcttaagtatgtgaccgtatttatgtacttttaaaatttttctgacagaagtaatcctaaaaacttatatggctattttatctttacatcttataagatatttttacatgtgttatcatgattggtcttcctaacagccatgagtggggagggctacactggtgtattcccatttttcaaaggagaaaacagacatagaaaggtcaaatgacttgcccaaagttataaatcccttttctggtatttcttatcaccttatattttcaataccttatatgacttcactacttcaagtttagctggctgttgtagtaatcatgtaatactagatttcagtctttctgtcactgtcgttcatacatgttatgtgctgccagccttcatttatttttgtggcaatatgttttctcctcttaaattctgttctttttaacatcctagtttgcccccacttccttttctctcattccaggtaagctaagcaggaaaactacaggggttttctggtttgtttgttttttctttctgctggaaagatacacgtaaatttagaattagtcagctggactcagtttagatgatcccaattttgttggcaacatccaaagcattgtaatcaggagccagtcgaacgtatgccttcttctctccatcaggtcaaatcagggtgttgatttgccacatcagtatcatagagcttcttcacagcctgtttgatctggtgcttgttggctttaacatccacaatgaacacaagtgtgctgttgtctcctatcttcttcatggccgacacagtggtcagcggaaacttggtgatagcatagtagtcaagcttgtttctcctgggggcactcctccgaggatatttgggctgcctacagagtcgcagtgacttgggccgctggaaggtgaggggtgtgtggatcttcttttttgtgtgtgtggttgtggacacctttcaacactgtcttcttggccttcaaagcctttgctttggctttgactttaggaggggcaggagcttccttcttccctttccgcgccatcttatcggggttttctgttttacagctacttctgagtacctgctgtggtggtggttcttataatttagactgggtacctcaagtcactctccagcttttgtgtatgttgaaactcttgcttttttttttttttttttttttttttgagacggagtctcactctgtctcccagactagagtgcaatggtgcgacctcagctcactgcaacctccccatctcctgtgaagcgattctcttgcctcagcctcccaagtagctgggattgcaggcatgcaccaccactcccagctaatttttatattttcagtagagacagggtttcaccatgttggccaggatggtctcgatctcctgacctcatgatccacctgccacggcctccaaaagtgctaggataacaggcatgagccaccacgcccggcccaaaactcttgaatagaaaagtcatacagagctgcctgctgaggtgctacaactggaaggtgaggttgagttttccaatggtgacaggtgtgagcctgtttgggggaaatgagataaattggaggcttttgcaatctccctttattaagtagttggtttatagcaaccatttattctctgctatggaatctgcttaaaacagaagctggaagatcctactggtacccaggtaatttcattatagctgctttatgtctccagactactgaggtttaaatctcctctctgctgtttactaacttggtgatttggtggtaagcaacttcatctctctgtgccttagtttcctcatttttaaatttcattcaattcaatttaatttttattttctgtttttgaaacagggtctctctgcacccaggctagactgcggtggcacaatcatagctcactgtagcctctaccttctggtctcatgtgatcctcttgcctcagcctcacacaacaacatgcctggctaatttttaaatttttggtagagatggggtctcactatgttgcccaggctattctcaaactcctgagctcaagttatcctcccgccttggcctcccaaagtgctggaactacaagcatgagccactgtgccaggccctctttcttcctttttaaaatgaggaaataatggtgcctactactagggttgtaaggattaaatgaagatatctatagatagataaatagatataaacagaacagtgtctgacacaaagtaagcactcaatgaatgtcggctgttatagttctttttatcaccattccattattaatgtcatgctgcagagatatcctgaaggctttcccaaaggcccattgcaacactactcttaattcctctggaagatgtgcaataaaattgtctgaaaataaatgtgtactgtagtctttctcaaaacccttaagcattgatttttatttttaaatagttccagtacttcttataggttagaggccaaagatgaatgatatctgcttaagatcttcctaagtgattagttgtgttgtccttaaatgtgttcttcttttagcagacagtttttcagaaagaaggtgctcaccagatttgaggtattagaaaatggttggggagcactataatttgagtcagaggactaaagtttcagttctgattctagcacttctaaactatgtgatgtcaggcctccaaatttattatgtgtgaaatggaaattatatgaaagctgtgtatttccttactgtaaagctatgttgatgtatataagacattatttgaattgtccaaatgctgtatcctgtcaaagcacaaggtctttcttaggcccgggtcagggtttccagtgctctgctttctttttagttgtaggttctaatgactctgctttgcaccccttgtcactttatctctaggcatttttccctttcagggttggccaaaggatgggatgttttcttcttagccagcacctgctccagttccttggaggcactgttcacttttgtaagacaagctgatcattataggaaatgccacttttgtataatataaacttggggacatgacaaaagttacataattttatcaaactcctgtagtcacagtacctggaatgtggtttgtgatgtcctgcatatatgagacattgacccactggcgatgggactcaatcttcttccctatttcttcctcctctgtttccttctataggacccatgcccttaggagaaggaccagaaagtccagcttgtagacacaaaggcttgaagagccaatccaagcagaataatggttattacctcaagttggtaatttgcatttctggtgtcctcctgcctgagtgattcacatctcaatggcccaggccatatatactataacccccttttgtatatttccttaccacttccctgacagcttttgtgcagctgtctggtctctcttaggcacttagagcagaaattccaactctagagaagagcaagaggctcataaatccctcttcaaaaaaaaacagagccttctttaagaccttctgtgggccttaattttcttcagttttcaattttgcctgggtaaatattttttaaaattaaatttaaaaaaggaggttatataccttcccagtatctttccttatagtcattcctaccaatatttagaaggttgaccaggattacctaatggctattccatttggctgttttctgggtgagggcactagccagaaatggctgagacattattaattgtcagctctccctcttatactattttactaaaatatttgtgatataggagggccaagaagtatttttcaggctccttgattgttgctattaaagcttttgaagatgggcagttatagttctggatatggctctatctttcctcatttccctgatcattcattcctttattcactggacattagtacatagtgtataggagatgctctgctaaaagatagggatacaaaaaaaggaacaagactaggtaactattgaagggctcacctggtggtgaaggaaacggacagttcctctttgtgccaggtactgttgtaaatacttgaacatatatcaacttgatacatcctcatagtaattctgtgacctggtactataattattcccattttacagatgagaaaacagacacaggaggctggaaaaactttgcccaacttcttactgttaagaagtcacagaatcagaatgtgattctaggcactcactccagagcccacatgttttactacactttgagagcaatgtggagtattgaccagaaggggaaggaagtgactatgaaatgatgaagggctagatttaagagatatatctgcaggagaattattatagctgataaccaactggctgaagatagggagagaggagtcaaaggtggctgacccctaggtttttagactgatagactgggtttatggtggtgctagaaattaagattagaaatataagaggtggagcaggtttgtgaactcatggggtataaaagtcctatttgatacacaggacagattctttgggccagagttcaagattctgataatcaacaataataatggtggtgataatagctaactgagagtgttctatatgccaggatttgttttaagtgtatttacatgtacagttattcatcccttaatgaaggggatatgttctgcaaaatacatccttagacaatttttacattgtgtgaatatcatagaatgtactaacataaacctagatggtataatctactacaacctaggctatatggtatagcttattgctcctaggctacaaacttctatagcatgttactgtactggacactgtaggcagttgtagcataatggtgtatatttgtgtatctaaacatagaaaaggcacagttaaaatatggcataaaagattttaaaatggtgtacctgaacaccacttaacatgaaggaaacttgcagaactagaagttgctctgagtaagtcacttagtgagtagcgagtgaatgttaaggcctaggacattactgtaccttactttagactttttaaacagtgtacactaggctacactaaatttataaacaattttttcttataaattaaccttagcttactataacttttttagcttaaaacacaaatcctgtacagctgtacaaaaatattttatttctttgtattcttattttataagcttttttctattgttaattattttttttttgctttttacaagtttttgttaaaaactaagacacaaagacacatcagcctaggcctatgagggtcaggatcatcaatatcactgtcttctaccttatatcttgtcccactggaagatcttcaggggtaataacatgcatggagctgccgtctggtatgacaacaataccttcttctgggatacctcctgaaagacctgcctgagaatgttttataattaacttttttttagtaagtagaaggagtacactctaaaatgatgatagaatgtatagtgtagtaaatacagaaaacaataacatagtcatttgttatcattgttaagtattacatactgtatataattatattgactgacagcacagtcgatttgtttacaccagcatcaccacaaatacatgagtaatgctttgcactgtgacattacagcgggtatgatatcactaggtgataggaattttttagctctgttataattgtatagaatcattgtcgtatctatgagaacacttggacacaggaaggggaacatcacacactggggcctgtcatggggtggggggagagcggagggatagcattaggagatatacttaatgtaaatgacgagttaatgggtgcagcacaccaacatggcacatggatacatatgtaacaaacctgcacgttgtgcacgtgtaccctagaacttaaagtatgaaaaaaaaaagaacagtgtcgtatctgtgggtcatcgttgactgaaacgtcattacatggcatatgaatgtattaacatggaatgttcacattaactctgttaaggcaataccgtgttaccccctcttttggcaggtgaagaaactgaggttcatagaagctaatatagcctctcagaatcactctgcttcctcaactctgctgtctcttaatccataggaatcgaagaacagattggagttggctgtcttaagttgtacttgctagaaataatgaagcctgttgaaggtgttgtgtgaatgcagagggagaatcgaatcttctccactcctacgcatggttctggcagcaacaaagaaagctctcctggcgttttggtgcccccctgtgggctgtatgagagttacctgacctcacattctttttccaccatcacacctccttttcctgtcttagaaatcagaaaaagcttagctaccctctctaccacctctcacttcatagttaattacacctcaggcatctttcatgcataaattctctaattttctttcgttcttttccacccttttccaatttctgtacttgagaaaacacattccctcactctccttttctgtcactgtcatcaaaaaccttcgaaaatgtgattaaacacctaccatgtaccaggcaatgttctagggccttggaatacattagtgaaaaaaacaaagatgaaagtatctgcctgcaaggagctcagattctattggaagtcagttttcttaattctggcttctactattcttattacttactacagttcctccattaacctgttaaaagagaaactttagacaaattacacttaacagtttaatcgagcaaagaatgattcatgaatcaggcagcccccagaagaaataatagattcagagcaactctggggctgccatgtagtcagataatatttatggacagaaaatggaagtgaggtacagaaacagctggattggttatatctcagtatttgccttattcaaacactttgagttgttgactgcctgtaattggctgaaactctgtgattggcgcaacagtagattacactgtctacacatccagttaggttatggttcattatggatggggaaacctttaggctgaacttgaaatatgtaaggaggaagctttaagctaaccttaatttaacaaaccccacccccaagttccatggaagccttagggttctgcagaggatagtctgaaatcttttaatcatagatggacaagttgtggcttaggaaaaaaaaggccttgccaaagattatgggatgtgagtgctgcacatctaactcccagaaaatctggttgaggaagaaagctagtaggtgcttctagtatgaatgactgatggtttaaggcagctgaattaagacactaattcctttttttaagaggaaaaactaaagaagaaagagaaaactgtttttattaccccacctggcttgcagatttaagagacgtagacagataaaatacgtctctagagagatttggccttgatgtgtaaataagttcactcgggtaaatatatatataggagcttggaactccttcaagcaagaactagaccaggaaggtagaatactgaaaactgtagctatactgatgttcctctgaaggcagagcatgttggagaaataggaagaaacagattacctgcatgcagtttggtggaggggagcagctaatattattggggaaaagttaggtccatcttgatgagtaaaataaatcagaaggtttcaatgacttatcagtatctggtaagcactgaaagataaaggtcatagaacacacataacattaatggcatatttatgcatatagtgggttagattttattctgaaagttgtcttttccttttctcttttccagatatggataaactcataaacaacttggaggtccaacttaattcagaaggtggctcaatgcaggtattcaagcaggtcagttatcaggaaaatagggtgctaatattgggccataatagtattgaatacctggtagtgattacagaatttaaactcatttttctttctataacatgtttggggattgagaagaggtgaaggaagacatatttctagaaagtatatgaatgccttggtttcatagtcagctggggagtagatctggcctaaaagaaacatagcctctggaatcaaggctataaagacaagagtagacctttagtagacaatagcaactatttatatagcactatttcatatttcagataggatgaagattaaatgcattgtcttatttaatcttcaccataatcctgttgaacagtgtattaattagtattctccagagaaacagaaccaacaggatatgtgtgtatggtgtatgtgtgtgtgtatgcatatatgtacatggagagagagagagagagagatttcaagaaattggctcattagattgtggaggcatggcaagtccaaaaccccatcaggggtaggccggcaggctggagattcagaaggagttacagtttgagtccaaaagcagattgtgagaagaattctttcttgctctatggaggacagtctttgttttaaaaactaaggtcttcaactgattggttgaggaccactcacattatagagagtaatgtgccctatttaaagtacaatgttttaaatgttggtctcatccaaaaaaataccttcacagaaacatctagaataatgtttgaccaaatatctgggcactgtagcccagccaagttgtcacataaaattaaccatcattattcttagtttccccatttgatggaaaataaaactggccttgaacactccaagaattaggattcgaaacaggttatctggattttatgtcccagggctctgtgctagatgttgaagtcccgtctttcttggggttgcaaattcactgcatgagtgaaactcaaatacagtcaaaattaaccttgaaaatccttaaatcacctatagacttgagtatacagtgttgtatatacaatacttgtctgtttctttatttaattcatcagataaagttggttacatttaggaatctttttgttataatttcaacttttattttattttttgaatttttatatatttatttatttatttatttatttatttgagacggagtctcgctttgtcacccaggatggagtgcagtggcacaatcttggctcactgcatcctctgccttccaggttcaagctattcttctgcctcagcctcctgagtagctgggactacaggcacgcaccaccatgcccggctaatttttgtatttttagtagggacagggtttcaccatattggctaggctggtctcgaactcctgacctcatgatccgcccacctcggcctcccaaagtgctgggtttataggtgtgagccaccgtacctggccttatttttaatttttgtaggtacatagtaggcgtatatatttatgggatacattgagatgttttcatacaggcatgcaatgtgaaataatcacattatggagaatggggtatccatccctgcagcatttatcctttgtgttacaaacaatgcaattacactcttttagatattttttaagtgtacaattaagttattattgactctagtcaccctatcatgctatcaaatagtaggtcttatttgttatttccaacttttttttgtttttgagatggagtctctctctgttgcccaggctggagtacagtggtggcttctcagctcactgcaacctccgcctcccagattcaagcaattatcttgcctcagcctcctgagtagctaggactacaggcacatgccaccacgcccagctaattgtttgtatttttagtagagacagggtttcaccatgttggccaggctggtctcaaaatcctgacctcaggtgatctgcccatgtcggcctcccaaagtgctggggattacaggagagagccactgcacccagacaatttctaactattttttcgtacacattcaccatgaccacctcctcctcaacaccccactgcccttcccagcctctggtaaccatccttctactctctatgtccatgagttcaatggtttcgatttttagatcccacaaataaataagaacatgtgatatttgtctttctatacctgacttatttcactgaacataataatctccagttccacccatgttattgcaaatgacaggatctcattctttttatggctgaatagtactccattgtgtatctgtaacacattttctttatccattcatctgttgatgaatacttaggttgcttccaaatcttagctattgtgaatagtgctgcaacaaacatggaagtgcagatatctctttgatatactgatttcctttctttttggtatatacccagcagtgggattgctggatcatatagtagctcaattttcaatttttttgaggaacctccaaattgttctccatagtggctgtactaatttacattcccaccaacagtgcacaagtgttttcttttctccacatcctcaccagcatttattattgcctaactcttggataaaagccattttaaatatctcattgtagttttgatttacatttctctgatgatcactgatgttgagcaccttttcatatacctgtttgccatttgtatgtcttcttctgagaaatgtctattcaaatgttttacccatttttaaattgaattattagacttttttctattgagttgtttgagctcattatatattctggtgattaatctgttgtcagatgggtagtttacaaatattttctcccaatctatgggttgtctcttcactttgttgattgaatcctttgctttgcagaagctttttaattgatgtgatcccatttgttcctgtttgctttggttgcctgtgtttgtggggtattgctcaagaaatttttgcccagaccaatgtcctggagattttcccaaatattttctgcagcagtttcatagtttgaggtcttagatttaactctttaatccattttaatttaatttttgtatatggttagagatagggttctggtttcatttttctgcatatggatatccaggtttcccagcaccatttattgaagagaccacgcattccccaatgtatgttcctggcacctttgtaaaaaatgaattctttgtagatgtatggctttatttctgggttctctattttgttccattgcactgtatgtttgttttcatgccaatacaatgccattttggttactatagctctatagtataacttgaagtcaggtaatgtgattccttcagttttgttctttttgcttaggataacaggctattctcggtatttgtggtttgatataaattttcggatttcgtttttctatttttgtacataatgtctttttttctttttcttttttttttttttgagatgttgtctcactctgttgcccaggccggagtgcagtggcacaatcttggctcattgcaaccttcacctcctggcttccagcaattcttgtgcctcagcctcccaagtagcagggactatgggcatgtgccaccatgcccagctaatttttttttttttttttggcagagacggggtttcaccatgttaaccagactggtcctgaactcctaacctgaagtgatccacccacctctttgtgttcccaaagtgtgtcaacagtgaacaatctgacaaagcaacactttgcttcccaaagtgttgagattacagacatgagccactgcgcccagacaagaatgtcattggtattttgatagggattttattgaatctgtattgtgttttaggtagcattgaagcaggatatttccttgaccccttcgtgggtgggaactggagtgcactggtgctggacctagctggcgctttggcactagcaggggcgaattccactcacttaaacctgctgtgttctaccccttgtgggaggggaatcacaggtcagtgggtgcaggagctggggtgagtgcctttgggcaccggcaggagcaaaactctatgcgcaccccacagcagagtccggggggcggggtgcctgcgacccttgaagccccagaaggagtgttacagtacccttttagctttgctgtttgcagatggcttaagcattaacagctcaccagagggtcagtgtgacagccttctgcacccacactgaagttcttgtctggcatccaggaggaatgaggttacacaatgaatcaaaggtggttaatgtgggagattttattgctgatcaaagtggctatcagtgggagggggagctgaaaaggggatggagtgggaaggtaatcttcccctggattccagctgtccccatctggactcctctccaaagctatgccatcaagctgtccctctgaagtcaagccacttctctccaacatccaactataatctccaacgtttagctgcttctcctctttctgccagctgagcctgggtttttatgggcacaggatagggggcagggtcaaccatgggtggttttggaaaaggcaacattcaagcaggaaaacggaaatataagttctcactttggactgtggttccaggcttcagggtggggccctcaccagggacctgcccacttctgcctagaatttccctgcctcctgtccctgtcagtatggacatttcaacaatattgattcttccaatccatgaacatagaatatttttccattttttgatgtcctcttcaatttctttcttcagtgttttatagttttcattgtagacatctcccacttctttggttaatttgtaggtatttaattttatgtgtggctattgtaaacaggtttacttttttatttctttttcagattgttcactgttgacataaagatgctactgatttgattagtttgattttctatactgcagctttactgaatttgtttatgggttctaatagttttttgtggagtttttaggtttttccaaatataggatcatatcatctgcaaacaaaaataatttgacttctttttttccaatttgaatgccctttatatctttctcttttctgatggctctagccaggacttccaatactatgtggaataacagtgttgacaatgggcatccttgacatgtgccaggtcttagaggaaaggctttcagtttttccccattcgatatgatactagctgtgggtctgttttatatggcttttattatgctgaggtgttacttgtatccccagttttttgaagggatgttgaattttatcaaatgctttttcagcatcaattgaaataatcatggtctttaatccttcattctgttgatattatgtatcacattgattgatttgtgtgttgaactgtctttgcacccagggatcccacttggtcaggatgaaggatctttctaatatattgttgaatttggtttgccagtagcttgttgaggatttttgcatcagtattcatcagagatattggcctgtaattttctttttttgaagtgtctttgtctggttttggtatcagggtaatactggccttgtagaatgagtttggaaatagttcctcctctatttttcagaatagtttcagtagaattggtatgagctcttctttaaatgtttggtagaattcagctgtgaagccatcaggtcctgggcttttctttactaggagactttttattatggcttcaatctcattacttgttattggtctgttcatgttttggatttcatggttcaatcttggtaggttatatgtgtctaggaatttgtccatttttttctagatttttcaattcattgacatgtaattgctcatagtggctactaatgatcctttgaatttctgcaatatcagttgtaatgtctcctttttcatttctgatattatttatttggatcttctctctttttttctcattagcctggctaaaggtatgtcaattttgtttaacttttcaaaaaacaactttttgtttcactgatcttttgtattttatttcaaattcttttaattctcctctcatctttgttatttcttctactaattttggggttggtttgctcttgtttttctatttttttttccaaaagaatatgcaggtatcattgcttttctaggtctttaagatgaattattagattgtctgtttgaagttttttctgtcttctgatgtaggcacttacagctataaaacttccctcttatgactgtttttgctatattccataggttttgatatgttgttttccattatcacttgtttcaagaaatttttcaattttcttcttaatttcttcattgactcactggtcattcaggagcaatttttgttgtagttggtttttttgtttgtttgtgacagagtttcactgttgttgcccagtctggagtgaaatggtgtgatctcagctcactgcaacttctgtcccctgagttcaagtgattttcctgcctcaggctcccaaatagctgggattacaggcatgtgccaccacacctggctaattttgtatttttagtagagacggggtttctccatgttggtcaggctggtctcgaactcccaacctcaggtgatctgtctgcctcggcctcccaaagtgctgggattacaggcgtgagccaccttgcctggcaggagcatattttttaatttccctaattaagttaaagtttaataatattattaaacattaataaattaatgttttataatactactggtgtatggtgtttgtatagtttcctaaattcctcttgttattaatttctagttttattctattgtggtcagagaagatgcttgatgttatttcaggttttctgagtgtcttaaggtgtgttttgtcacctaacgtatagtctgtcactgagaatgatccttgtgctggggaaaacaatgtgtattcttcggccattggatgaaatgttctgtaaatatatattggatccatttggtctatagtgcagattaagtctgatgtttctttgttgagtgtcttcaacttttattttagattcaggggatacatgtgcaggtttgttacatgggtgtattgtgtgatgccgaggtttgggatatggatgatcttgtcaccatggtagtaagcatagtattcaatggtttttcaacccttgttctcctctctccctccttcttctagtagtacccagtgtctatttttgccatctttatgtccatgagtacccaacgtttagctctcataaataagaacatgcagtatttggtttcctgttcctgcattaattcccttaggagaatagcctctagctgtatccatattgctgcaaaagacatgattttgttcttatttatgtctacatagtattccatggtatatctttaccacattttcttgatccattccgccatcgatgggcgcttacgttgatttcatgtctttgctattgtgaataatgctgtgatgaacatataagtgcaggtatatttttggtagaatgatttattttcttttgtatatataccgagtaataggattgctgggtcaaatggtagttctgtattaagttccttgagaaatctaggagtcagttttaaaaattgttctcaatcattgtttggcccatggtgtataaatgaatttgcttaagttgcatatgcatatggatgagaatcctttgtactgttttaatgatatttagccctatttgatgtcccatttaccttaatcgtagcttttgcatttaggaattattagcacatcaaaacttgctaattgttggaaaacttctgcctgttgctagagcttactcatagttaataccaagaggaagctgagtataagtagtattagataaaaatctattgtacttgtaataaaaaatactctatgaaatgtcattgagcgtgcatagctacctttgttgttgttgttgttgttttgagatggagtcttgctctgtcacccaggcttgagtgcagtggtgtgatctcggttcaccgcaagctccgcctcctgcgttcacgccattctcctgcctcagcctcccaagtagctgggaccacaggcgcctgccaccacacctcgctaattttgttttgtactgttagtagagacagggtttcaccatgttagccaggatggtcttgatctcctgacctcgtgatctgccagcctcggcctcccaaagtgctgggattacaggcgtgagccaccgcacctggccaaagctaccttattttgagatctcagtgtacctaagtataattctagaaatgtttttctatgcattctttaggtatactgaacttccagaatttggaggcactttgaaattggttcaatgtgtagaaaagtctggatagtaagggatctaagcactttttttgtttgtttcttggcatttccaggatatcttatttttagaaaagcctgagtgcttgtgatacatggccacagcacactggccatgtctcaggtgacaaggaccaggagtttgtgttctataactacgcaatgctggcatcattctagtgtggagaagcctcctggtttgattcattataggatttgtttatttcaaaagttaggactagtgggtgggtgtgtagctcagggcacacatgctgctctcccttctctaaatttctgtatcaacataccatgcagtgaaagagcatttggttgtcacctgccctttatttttcgtttctgattacttcctacaagtgggatgtcttggtcaaaatgtatgagcagtgttagggttaaattttatcatacatgtctctcctttaccctaatttaatattgttaatatttggcacatattttcacacagcctaattctctctctctctctccccccattttattactattgtaagttgcatcaagaaactttacccctaaattattctgcatgcatcacctacaaataatgacattgtcctacataactacatcagcactgtcacgcccaagaaaatgaacaatatttccatgatactatctaactggctcatacctttcttttttttcctctctttttttaaagctgggctgctttctcagggttcatacatttctgtgccacttttccccacactgttttttctacatggattgtgcctcagtgagctagtatagctcaccaaactctttacttttcttagggttcaaattccaattctacctcttccatgaaacatacatagaaaaccccaactgtctcgaatctctagtgaaatcatgctcctggaacactaaattatctgtattagtcactaatgtggtacctgttctctattgtcaactgctttatgtaaatatctcttgtctccccagtaatattttttgtctcccaaacttcaattatttacttaccactttcacgatttttgccacatccttgccatcaatattatttacatactttaaaattatttaaataaataaataaataaatctatattagttttgtcctaagctatctggagaattctcggtttgatgtgaagtattactttcctagaattgctgaaacaaactaccacaaactaggtgggttaaaacaagagaaatgtgttctctcactgttctggaggccagaaatctgaaatcaagttattgtcagggtcatgctgcctctgaaggctttagtgaagaaacttttccttacctcttccagcttctggtacatataggtattctttggcttgtagccccatcaccccactgtcagcctgcatcttcacattaccttctcctctgtggctctgtgcgttattcctctgtatgtctcttataaggacactagtcattgaatttagggcccacccagataatccagcaggatctcttcaagatctttaattacatctgcaaagatactttttccaaaaagactctgggaattgaggtgtagacgagtgtttttgagggtcaccattcagcccactacaatgtgttatatatattttccaatgtacagtacaatagagtaagcataaatattaaaataaaataacttcatccatgtattacccaaaaacaaccttagattctttgagaaacaaaaactgatttagtatttttcacattttctatagttttgtgctaggtactaagcaaatacctagtgaacaaatatatgcatacatatacatatgtacatacatttgtacatttatgatctcattttgcctgattgtggctactaccatcccaatctcttaaaattgccgggtttgttagattaagtctaggtttctaataatacccatctccatccaccgctccattttctaatacccaaacagataatgctcttattggaaaaagaattgagttttagaaggttaaacagactttttgacctaaacatgaatgtgtacaatacatgtgtgcatatgtatccaggcataaaactaattggtttaacccagagcaaagctggaaggtacctgtttacaaaaacaggtttcctctttctgtttgggaggagcctaggctttatcgtgtttctataacatcccttcctctccttccacctactgtgctgtatatagtattttgttcttcatttctaatcttgcattaccactttcaagctccacatcagagctgtttcaaatacatgaaaaatggaaactttgtaacagttgattccactgattctcagggcctctctacctatcttaatcaaatgcttaaatatttgtgaaattaaccaacttttctcagagtttatttctagaattgagaggggtgtttcctaagaaccgaaagggtctcatctttagtaatatatgaataaataactctttttatatttttttgtccactcaaattggcttaaggaaacctgataaggattctgggtatttgaggagtagcactgtggaaattaaagcttgtcttcaaaccacccctaagtttctttgttttctttcatgcacaaccttcttcatagattcagaaatccggaaattcaggataaagtcttaaaatagcaaatggggaaagtagctattctctttgatagtgattgactagagaacacttaaaaactgaagccatcacaccacactaaaaatgaagaaagattactttaaaagaaaaatctgatgacagaacaatcctcagatgagtttcaaagctgaagtgattatattcaatgaagcatgaaataggtagccatcctgagtcatcttagtgaggattcttaaaatcaccaaaattctagggacaaaaactcactcaatcaagacttgaaggtcttcttcagaaccttcaagcataatatgctatctataaagataaggtaaagcaaatagggtgttggggttttttttaaccatagggagggttatattcaaactatggaataagttagactgtataacaatatttttattaaaattattttgatcatattgaaaaaagaatcctcagtgcacacaaacaaaacttattcaccctgatagtgtgtagatatggaatgcttgtctttaagccacaaaggaaggaacagtaaggtcaaccttgagacctacttttgagaacagtctgttttcttaagaaagcttgcattcagaagacaatatttacacccagaaaatacttgctacaagatagattcacttagacataagaggcatacttgggagtgatatgtacagaaaaaagtatgtgacactatgctttgaggaagttactattaagatactaaaacccaaacaactccccttccaacacttctctcaaagccttttgatggcaggagagaagtaatgattgaagccctgctgcagacagggtttggttaagaattggcaaaccacaaaataggtttagtctatgaaaggacaactaatgatggcctgttggagcaggaccctgtaacactgtatctcatcaaggcaataagaataggctatcagttcttcagtttcttgactttcatcaatcagtttccattttagatgttcctacgtaatgtttttcaataaaatgcatacctgcagatcaagtatcagctaaacacaaggccttgagctagtaacattgttgtaggcagcactcatctcactgaaatggcctttctttggcaaaagagagtaaaagttgccaaagtcgtgtttattttatagttaggattcaaagcttcagctttttcaggtttcttagtccaaaaagtccctaaaatttagctaaatcttttcttaatttcagtggcaagttgtgtttatttatacacctgcacccacaactatattcttacagaaaatgatattacagtgaattattattattattattattatttttgtgtgacagagtctcattctgttgcccaggctggagggcagtgacaatcctcctgcctcaacctccagagtaactgggactacaggtgcatgctaccatacctggctaatttttgcatttttagtagagatggggttttaccatgttggccaggctggtctcgaactcctgacctcaagtgatccacctgccttggcctcccaaagtgctgggattacaggcatgagccaccgcgcccgccctacactgaacctcttcttatgctttctattgtaactctatttctcactgttattgacagcaatgatagactatggaaagagataacattttttcttttgaagattccttggattctatctttttaatctgggaatggagctactcaagtgaagagttatgtgggaaatgtaggaaaaataagagcttaagttgatttgggggattctgagaacaggggagttttatgttcagcagagccaatcttgacaacttcctctccctgtcaacaggattctactccccccttatctggatgggtcaaatccacccatgagggatgggttacatttgcagtatgtgaaacagtgggacaaatcacagaaatcatgtcctggaggagcagattgaagcaatgtttggaccacaaacaagggctgagttgggataggtgctggcaaatcaagaaaccaagagtgttgtagcataaaagaagggaaaagaagatggcagtctggccaaattctggagacaaagcacggatgggtttttggtgccgttactcattcccagcctgctctgagcattgttgtcatgtgtttttgacgcagagtcttgctctgtcacccagactggagtgcagtggtgtgattatagatcactgcagcgctctgagggtttttaaaataaagtcagagcaagaagacactgcctcccctgccacttattgctctctgaattcagacccttattatctctcacctaaattttaaaaaatcataagcataacataattatcacaccttaaaattaactaattcattaatattgtccaatatccagtcaatactcaaatatttttacatgtctcatcgagatttttccacttgctttcttttgaatgtctttgaatctagttttattcctctttcaatcaatcttcattaagaagctagttaaatctcacagaaatagttcttcccttgttactcctctcttccaaacaattatcttctatcacccaacctttcattgaactctacctttcctcatcttccaaatatacaaaactaaaagtggttatgttttatataaaggatgtattccttaacatttttcataatttaaaactcccataattcaagtatcatgctgatagataatggaagcttgtttgtttactggctaaagaggtggtaccaccatctccaaaatcatcttcaagatccagagtgttgcttggcagtggcatacacagttcattatatccttgacctttgaattcatggaattcttagaaagtttttaattaggttgaggctttatttcatatattacatataaatgatcatttattagttttttaaaaaaagtattagttttttattaaaaactattagttttttaaactaataaatgtatttattagttttttaaactaatgtatttattggttttttaaactaataaatgtatttattggttttttaaactaataaatgtatttattggttttttaaactaataaattggttttttaaactaataaatttatttattagtttaaatcatttatgatcatttagatcatttattagttttttttaaaaatcccagaattaaaaagttgcagagttcaattttgcatataatacaactaactgtattgcaagtttatttcatagtttattctataattatactgtctgttgttatggctctatagacaggaatatctttcttatctcttatctgcctagaaaatttctattaattttctatgactcagctgaaatatcacctcctccttgaagccttccctttctagtcagaatgagtcattcccttttgtttttctaaaacgccttgcttgtatgcctgttacattatttattatggtatgatttataaactattcacattattctatcattatatttaatatgttggtatgtacttattggctgtactttattgatgtgtgctgccactgagcttatagtagatgctcagaaagtgttgactttaaataattttgcaagattattgtgaacgttaaatgaaataatttttaacaattgccggatacagtacctggtacttacagatagtaaagtttcccgtctgtttttctctttagtttactcctgccttatttctcccagcaccatgtattccttccatgtgaaatgaatagagatttcttttttacattgcttgcatgtctcttcagggtactaacactgacttatgcatctctcatttgtttatttatttaaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcaggtaagtaacaatattgcctctttcctggccttcctgaatctattcccttttagagtcatcctatctcctgtctcttttcacttcctccaattattcttgcacactgcttcaagagtaatctttcaaaagtactgttttttatgtctttttaatgcttaagaatgtacaatgagtcttgattagaccatgcttctcaaacaagtacaagtatgcatatctatcagtgacatatcaaacaacttcctggaacttccacattatttgatattaaataatttaagcattttatatttaaaatatgattatcttgtattacaaaatgcaaaatttaaaaacctgttaagataaaccacatgcttcaaaaatagttgaagcttactaaaggcatccaccctcggacttttcaggagaatgtgtttattttatgccattcagaatgctttggtgggaaagttgagaacaatatttctatctcaaacatacttagccagtattagctcctgcctctaccaatactttcccttttctcttccctacaaaagaagtaattgaaatattgtcatcttccctgtgttcttcctcatttggcatctatcactttccattttacttatttatttgcctgtatcacaagagtttgggcattattcacaactgaattgtaaattcctgaaaaataatactctatcttaatttttttatgtatgcctccagagaacttaacacagtgctaggagttgtcttgcaacagataatttgatgaacaaacaaacttgaaaatttgtccaagagagaattcaaatgctataatcttccattttattttatttttaaaataagttcagaattcagaaaggtataaattaagtctctcttccaccactatcccccaaccactagttttcctcccagaggtatatctgttttagtttgtaatcaggaatgatcaaggaaaattatgtggcctctaaagcaggctgataatgttttgcataaatcggaaaggccaaggggtggaaatgactaggaagcagatttcagcttactgtaaaagagtatctacccttgaaatttgatgccctgtactaaatgtaggaggctgaaaaacaacatactactaagcatcaagttgctgagactctgcactggtcttctgaatacaaatattattattgactagtggttaattgtggtaatgataagtgttcataatcttattttgagatgtgatatccattccatatatgaagggagagccaaacaaacaaaccaaaaaaaggaaacaaacaaaaaaggaaataaaattcctcgtgtgacagtttatgctgagataaaggcagtggtaacatcaaaggatggtttgaaggagctttgaatagtccccataatatcatcagtccatcagagccactctaaataaacaggataaattttaaatgtgctcaatgtggttccaagctaagggcattggcccaatggtgtctgtattagttcgttttcatgctgctgataaagacatactcgagactgggaagaaaaagaggtttaattggacttacagttccacatagctggggaggcctcagaatcatggtgggaggcaaaaggcacttcttacatggtggcagcaagagaaaaggaagaaagaatagcggaaagccctgataaacccatcagatctcatgagacttattcactatcatgagaatagcaggggaaaactggccaccatgattcaattaactcctcctgggtccctcccacaacatgtggaaattctgagagatacaattcaagttgagatttgggtgggggcacagccaaaccacatcagtatccaaaatggggggcttactaaaccttagggggcacatataaaacaattggagtgcaagaagaaagtatcaaaatttgtattttcttacccttaaaaattgacaggtaatattgtatgttttaatcatctatagcatgatgttttgaagtacatatgcattgtggaatggttaaatctagctaaataataaatgcattacctcattatcatttttgtggtgagagcacttaatgtccattctctttacaattttaataaataaaatgtatcatcattaactatacttgccttgctatacaatagatctcttgaaatgtattcctcctatctagctataattacgtatcctttgaccaatatctccccatccccctccccactagccaccccagcctctggtaactaccattctactctacttgcatgagattaacttttttagattccacatatgagtgagatcatgcactatttgtccttctgtgcctggcatatttcacttaacataatgtcctccaggttcatctatgctctcacaaatggcaggattttattctttgttataactgaataatattatattgtatatatatatatgtcacatttcatttattcattcatttgttgatagatattttaggttggttccacatcttggctgttgtgaataatgctgcactaaacagggatgcagttatcttttgggcatgtgattttatttcctttggatatatacccagaagggagattgccagatcatacggtagttctaattttaagtttttgaggaacctccatactattttccataaaggctataactagtttacattcccatcaacagtgtgtaagtgttcccttttctccacatactcaccagcacttactgtcttttgtcttttcgataatagtcactctaacttaagtgagatgacatactactttttgtttgttttcttataatgtatacaaaattgtaggataccgatacatgtatatcacatacatgcacaaacatgcacacctcaagatacatgcttaaaactttttagtgaatgatatgcaaagtatagagacaactcttttaaccaaatacttgttccccaccttatcaccacccccaagtttcttctctatagaaattttgaaggtttcactggatctaggagactgttgaccacctgattgagtttttaggaattagaaacatcaggggttgataataaggaatatttgacagcttctcccaacataggtggaaaggaaggttgtatcaagcacctactaggtggtaggtatacgtttcatctcattgacttatttctgtttaggagcacaaaggccaaggtggatgttctcacatctggactaatcctagaatttgattttaggacagccaggagctattcagtgagttcaattcaacacacacacacacacacacacgttgaaactaacttttcagctgaccctgtcctggtagctggagatagaaagatgaatcatacccagaccacatcctagagacactctcatttgataccactcatagtggtatcagaactcttcatactactcttactttaaaggcatttctgttccctgctatgcaaaaaaaaaaaataaaatgttattctcttccttccatgcaaatacacttctttcatcttgttttttatttctttatttttctgtcttgctgccacttcttaaggtgggacaaactgggaatcctgaaaatgattaaagaggcacatacatcttcagctcacactgctccctttctttgcttttagtgaaagttgaccccacctccatgtctccactggaaattccaagtgacagtgaggagagtacaattgagagtggatcctcagccttgcagagtctgcagggactacagcaagagtgagtactttttgtcttcaagtctgtctttgtgtatgtgtgtgtgtgtgtgtgtgtgtacatttgcacatatgtataggtggaactaatgatcagacacaagagtaagaatttgaggacaagaaatatagggagactgcctttccagtgaaagtatatgagtttgtgtgcacacatgtgcatgtacatgcatgctatagtagagctatgttctaactgtagatcatcaatttttcttttgaaaaatcttcaaatttcccataaagtgtagttatgtactgtttctctctgtaagtttaaaacagctttgtctttcaatattgaaactaattggaagtagttggcttgtgtttagcaacaactgttgtatgaaaaacaaatttctttaagcaggaaaatgaaacttattgaagtgaaatgctcacactgtttgggaacacaaccactgaaggaaacactaccacctcccatgctttctctgagcacctactgagggacctgtacctactgagcagaatggcctagttgacagaattgtttttactattccaattatttctttttggggggacctagcattaaattcacgtaaattaaaagccgatatgatgtggcaccaatgaatgtaaattcatttttttagccttcactttaaagtcactgtttggctttatctctatttctttgatcagaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggtctgcccactcccatctcacccccaacacacacacacacacacacacacacacacacacgagagagagagagagagaggggcagagagagagagagagaggggcagagagagagagagaaaatttctgagagacagagaatgaagtcctgaaacaaagactgatgcatttatactcatgggcacaggctccattcatggtttttatccctatttcttgtccctactctaaggcagattttataaaactggcctaggaaaacactaaactaaatctggtgtcttaatagtcatcattcccagtgagccctgtgggtctttctaattgcggagtcaacacttaagcaaagattaaggcattactcccttccttactaccagggtctcacaagttttactaagcatggaaaagcacaagaacaatttaaactatgtgaaattaaagcaggttgtaatccactaaccattaacgtgtctttgttcacattaaaaaaaaaaggtgcacataaataaataaagcagacctggtagtgatcctgtcaaaccgaacagcacatacctgatctgaagaaggagagctgccactcaaatccatgtagtcagccatcaatattcttaggttccacatccgtggattcaaccaaccacaaatcaaaaatattttttaaacaacaaaaataacaatacaacaataaaaaaatacaaattttaaaatacagtataacaactacttacatagcatttacatggtattaggtaacgtaagtacatctagagatgacttaaaatataggagagaatgtgtatagattatatgcaaatgctatgttattttatatcagggacttaagcatccatgaatttcgttatccacccgatgggtggggttgggaatgtaggtggctctgaaatcaatcccccatggatactgagggacgactgtattagtaaatttaattgttaaagaaaagcaaaaaaaaaaaatccagattattatgtgaaatgtccttgattttgaatgttggcttctagttcaaaaattttttataaccccaggaattcaaagaaacctgcctagaagccagatgcagcttgtcatttatcaatgtgtgccctttgccttggagactccttctccatagtggtctccaagctcagaattgggacttagacaccttggacaaggaggaagccctcctttcttgtaaacatctgctatgttacctttgctgtgttagaatttgtgtagaaggacccagagccctagttgttttgcctagaggctatgaacaggtgagtgatttccaggctgcattattcaaacattcccatgacactattattatttagtgatgtatttgtttgcttctcttccatgggagatggatgctgactatatatatattccatatattccaagtctccaattaagctgctgtgggatctgatatgtcttcctacctctttgatcttaggttcctcaaccgtaagatgaggggtttggactaggtaatcccacttgactattttaatctggaactctatggattgaatttcaatgtaacctattgtgcggctaccttctaggaggtcccaagtgtaggcaggttggaaattactttatgatatactaaaagtctggctgtctttcctatgtcacctctcgactcttaaactgagataacagatacaatttacttttatttacttttcggatttcagtactgtttttctccctagtggtgtaagcttcccatatgaagggaaaaaatggccctaaaatatccacaattcttagctttgagtgttataggtgaatgccttacctgataagagatcatgacagccagatgactgatgaatggagacaactgatgtctacatgaatctcactacatttttttttttgagacagttttgctctgttgcccaggctggagtttagcctggcgtgatctcggatcactgcaacctctgcctcctgggttcaagcgattctcatgtctcagccacccgagtagctgggattacaggcatgtgccaccttgcccagctaatttttctatttttagtagagatggggttccaccatgttggccaggctggtttcaaactcctgacttcaagtcatctgcctgcctggacctcccagagtgttgggattacagacgtgagtcactgcccctaacctcactttgtttagattcggaattgttcttattctactcagtttttaggattgacccatacctttgccatgggtatgtgaccataggaatactcacttgaaggcatttcacagaaacatttaatttgccccaactgcttgacttacaataggcttagttgctttaggaaataacgtggcatttctgtaagtgccctcattcctgcagtattgtaataggcctttcctcactacaattcattctccacacagtagccagaggattttcatctgtttgcttttgttttgttttgtttaaatataaataagattatataacatctgctacttaaaatcttccaaggacttcccatcacactctgaatgaaatccaaatagagtatcctaaaaggccctacaggatcttgcctcttattaattttatctcatgacatttcttatccttttgatcccaatttgaatgtcttctgcccagaaaaatcttccctaaacctatcttaagcagtgtccactctcaaatatctgtataagaaaaccctacttaatttcttgatagagttttcttttctttcttttaaaatttttaataatacatattttaacccagtgtatcacaaatactatcactttacaacctaatcagtacgaacaattatttttattttattctcatattttgtgggtacgtagtaggtttatatatttatgagttacatgagatattttgatacaggaatgcaatgtgtaatagtcaaatcagagtaaaggggtatatctgtcccctcaagcatggggcatcctttgtgttacaaacaagctaattatactcttttagttattttaaaatgtacaattaaatgattttttttttactataatgaagctgttgtgctatcaaatgttaggccttattcattctctctattttttgtacccattaaccatccccactgccccccgacccactgacatcccaccatccttccctgcctctggtaaccatccttttacctctatctatgtaagttcaattattttaatttttagctaccacaaataagtgacaacatgtgaagtttgtcattttgtgcctggcttatttcacttaacataatgacctccagttttatccatattgttgcaaatgataggatctcattctccatgtgtgacctttgccttggagactcctccttagtggtctccaagctcagaattgggacttagacaccttagacaaagaggaagccctcctttcttgtaaacatctgctatgttacatttgctgtgtgagaatttgtgtagaaggacccagagccctagttgttttgcccagaggctatgaacaggtgagtgataaatgtctttttagctcttttgcccatatgcaccacattttctttatccattcatctgttgatggacaccagttacttccaaattctggctattgtgaatactgctgcaataaacatgagagtgcagatatctcattgatatactgatttcctttcttttggatatataaccagcagtgggattactggatcttatgatagccctactttgttttctgagaaacctccaaattgttctctatagtgattgtactaatttatattcccaccaacagtatatgagggttcctttttttccacattctcaccagcatttgttattacctgtattttggataaaagccattttaactgaggtgagatgttatctcattgtagttttgatttacgtttctccgattatcagtgatgttgagcaccttttcatatgcctgtttatcttcttttgataaatgtcttttcagcttttttgcccatttttaaattggattattagatttttctcctatagagttttttgaactctttgtatgttctgattatgaatcccttgttgatgggtagtttgcaggtattttctcccattctgtgagttgtctcttcactttgttgattgtttcctttgctgtgcagaagatttttttaactttatggcaccccatttgtccatttttgcttttattgcctatgcttgtggggtattgctcaacaaatctttgcccagttcaatgtcctggagactttccccaatattttcttgtaatagtttcagatcttagacataagcctttaatccattttgatttgatgtttgtatatggtgagatatagggttctagtttattcttttacctgtgatatccagttttcccagcaccctttattgaagagacagtccattccccaatgtatgatctcagcacctgtgtctaaaatgagttcactataaatgcatagatttatctctgggttctctattctgttccactgatcagtgtgtctgttatatgccagcagcacactattttgattactatacctctgtagtataatgtaaagtcacataatgtgattccttcagttttattatttttgcttaagatagctttggttattctgggtttttgtggttccatgtaaattttggggttttttttctatttatgcagaggattgtcgttaatattttgatagagattgcattaatattgtagattgctttgagtagtacaaacattttaacaaaatgtattccaccaatccatgaacacggaatatctttcctttcgtttctgtcttcagtttctatcatcaatgttttatagtatatattgtagagatcatttattttcttgtttatgttaattcctaggtatttcattttatttggagccattgtaaatgagattatttcttgatttatttttcagaatgttcatctgttggcatgtagaaatgttttggattttgtatgtcagttttttatcctataactttactaattttttttaatcaattctaatagctctttttctggaggctttaggtttttccaaatataagattatgtcttctgcaaacaaggataatttgtctttttcctttccaatttggatgccctttaattcttttctcatctgactcctctaggtaggacttcctgtaccatgttgaataaaggtgaaattgggcctccttgtcatgttcccaatcttagaggaaagtatttcagtttttccccatttagtatgatacttatgggtcagtaattaatgacttttattatgttgaagtatgtttctcctacacccagtcttctgaggatttttattatgaaaagatgttgaattttatcaaatactttttcagcatcaattgaagtgaccaaatggtttttatctttcattctgttgatatgatgtatcacattaattgatttgcatatgctgaaccatccccacatctgtgggataaatcccatttggacatgatgaattatctttttaatgtgttgctagtattttgttgaggatttttgcatcaatattcatcagtgatattggcctatggttttcattttttgatgtgtctttgtctggttttggtatcagggtaatactggcctcatagaatgagtttggagtatttcttcctgttctatttttcaaaatagtttcagtagaattgatatgagctaatctttaaatatttgttagaattcgacagtgaagccatcaggtcctgggctttccttcctgggagacctgccccccgcccccgcacctcgcccccgaaaccaagtctcactctgttgcccaggctgtagtgcagtggcatgatctcagctcactgcaacctccaccttctgggagagttttaattatggcttttgtctcattacttgttggttagtctgttcaggttttggatttcttcctgattctgtgtttttccttgtccttaatattaccagtgagttgtgtaccttcagatgatttcttattgctcattaatgtccttttctttctgattgaagtactccctttagcatttcttgtaggatgagcatggtattgatgaaatccctcagcttttgttcatctgggaaagtctttatttctccttcatgtttgaaggatattttcaccagatatactattctagggcaaaagtttttttcccttcagcatcttaaatatgtcatgccactctctactggcctttaaggtttctactaaaaagtctcgtcaaagatattggaactccagtgtatgttatttctttcttttctcttgcttcttttaggatcctttctttatccttgacctttgggagtttaattattaaatgctttgaggtggtcttctttgggttaaatttgcttggtgttctataaccttcttgtacttggatattgatatctttccctaggttgggaagttctgtgttattatccctttgaatatttctacccctatctctttatctacttgctctttaaggccaataactcttagatttgcctttttgaggctattttctagatcctatagttgttgcttcattgttttttattcttttgtctcctctctatgcattttcaaataggctgtcttcaagctcactaattttttcttctgctttattctatttaattgtttcaatctcttagttaacttacgggattctgaattccttctctgtattatcttgaatttctttgagtctcctcaaaacatattttgaattctctttctgaatggtcacatatctctccaggattggtccctggtgccttatgtggttcatttggtttggtcatgttttcctggatcgtcttgatgcttgtagatattcattagcgtctgggcattgaagagttaggtatttattgtagtcttcacagtctgggttggtttgtatccatccttctcaggaagtctttccacatattcaaagggattgggtgttgtgatctaagccatctctgcattaggggacaccccaagcccagaagccctatggttcttgcagacttgtagaggttccactttgatgttcttgaataagatccagaagaattttctggattaccaagcagaaactcttgttcttttcttttactttatcccagacaaacagtctctctctctgttctgagccacctagacctgagagtgggttgacacaagcatccctgtggccaccaccactcggacgtgctaggtcaggccttaaactaatacagcactggatttcagccaagaaccgctgtaaccactacctggctattgccagtgttcactcaaggccctgggtctctacaatcacctgttggtgaagcaagccgtacttatgtcttttccttcagggcagtgagttctcctaggcccttggtaggtccagagatgccatctggaagccaggaactctagtcaaaacttagaagtccacctggtgatctattgtactgtggctgaattggcactcaaaccatgagacacagttcttcctagtcttcccttcactttccacagccagaggagcctcaccccttggctaccactaccataggcttacagggagtacttccaggctactgctgatgttcccataaggcccaaggcctctttattcagcttatcgtgaatgctgcttggcctgggactcacgcttgagggcagtgggctcccctctggccctgggcagatccagaaatgccatgcaagagcataatcctggaactggagaccccaatatcctgcttgtgctctatccttctgtggccaattggtatctaaggcacaagacaaagtcccctttacttttctttccacctttcctcagctggagtgtctccccatagccatcacagcttgggaatgtgctgagtctcatctgaagccagcaagtctcagagtctcatcctaggcccatggtgtactacctaagttttgctactggttattcggggaccaagggctctttagtcagtaggtgatgcgtcctgccagaactgggttcttctcttcaaggcaacagcttcccctgtggcccagggtgtgtctagaaatgtcatccatgagctaggtcctggaaaagaagcctcacgactctgaatgatgccctatcctactgtggctaagcttgtatccaagatgcaaaacaaagtcctttttactctgccctcacctctcctcaagtggaaggaaggggtctcttttgaagctgtgagctgtgcatcctagggttggggaaggggtggtgcaaccactgccttatctgatccagctgatatcttaatatatcatatgctccccgcaagtccactggctctgagcccagttcatcactaggactcacctaagacttgaagtccttgtggcctatactgcctttcaagttaattcaaggccccagagcactttatctcatagtggtgagtcttcccagaattcaagttctgacttctgggatgggcgattcccttctggctctgactggtttaaatattccctccatgggtgggagtcagcagagttcagcatagttttgctttctgctgtgacaaggcagcactgaatttaatgcagtgtctcacaagtgctgtactatccctgtctgaagcacacagattctctctccacaccatgtaggcactgcagaaggatgggtgaggggtggtgttggtgattcaagactctttcctatcctctttcagtgcttcttttaacaatatgaagttaaaaccaggtactgtgagtggtcatctgatttttcgttctttttttttattattatactttaagtttagggtacatgtttacaactttcattcttatgaaggtccttttttgtgtagatagttgtgaaattggtgttcttgttggggcatgattggtagaacattctatttggcccccttgctctgcccctcttctccatttatttttcaattgtataagtttaaagggtacaagtgcagttttgttacatggatatgatacatagtgatgaagtctgaacttttagtgtaactaaggaagttttttaaagtagggagaataacgatcatatgagaaggagcaagctatgtaaaaagcgtggcaaaagactattcttggctagtcagagtacaaaactagtgagatgggaataagcttgccttgttctaataactgatactagttcagcttagctaggacatattgagcgcagcagtgggtggagaaagcattgaggtgcaagagtggaaggggtaagatcagttaagaggctaatgaagcaatccaggcaaaaaatgatgacagctcaactagtatgttgccagtggagatggagagaaggaggtacattgatgattaagtggatgttggtgactctaaggtttctgttttgggtgactgggtgaatggaggtgccatttatagagctagagaatttgccaatagttacacaggtagtaaatgggtaaagccccataggattagacatttgtacctaacctaggtatacttttctctattgctagtattccacaggttccctgggactgaggcagcgacagaaatgcctgattcattgccctccaaagattgtgattcattgttaagggtcctagagagtgccgtctctgtctttggtagatattcttccagcagagagccataagactctttgcttatctgcaaagaccaggcatgcagtgcagcacttcatctcccctgagtttgcaatcatacaaagcaggaaacacagatataacagttcttgttaaacatactgtgttcatactgtcaagtcccagtatatttacaatggcatcacccattttcccaggctccaaatgtatcattgattcttaccattatctttttttttccccaagtcagagtctcactctgtttccaatgctggagtgcagtagcacaatctcgactcactgcagccttgctctcccaggctcaagcaattctcccaccttaacctctggagtagctgggactacaggcacatgccaccacacctggctaattttgtttatttttttgtagaaatgaggtctcactatgttgcccaggttggtctcgaacttctggactcaagtgatcctcccgcctcagcttcccaaagtggttgggattataggcatgagccattaatattctcttatgtcttgagttatttgtatttaaagttctattatttctttctaattttgaatagcctttttattcataatggctaagactatgtattgtgaaactagtgtcttgatttgacatctcaatcagctactcactgctgaaagttgcttcgcccctctttacctaaatttcccaatcttggaattttaatagtgtaaaatacttaaaatagtatccagcatatagtgaatactcaataaatgctaggttttattaatgtttttctttcaattccaatctcgctgtcacctccttaggttttgttcttatatttattattgattccttcatcaattcaatgaaaaattaatttgagctttatatgccagacaaatagattaccccagtaggctcctagtcattgtagtccaccttatacagcatgggtaaataattttaatgtacaactttgaccaagtcattcttgagttaaacagactaacttttagactaacttttagtctgttttattattgttttaaagttctctattgtcaatgcatccccattattgctcacacctaggacagactgctctcacacacacccccttgggtatatcattgccttttatgcttaagtccaaattctctttttaaaaataatcccaagtttttcatctgtcttttataataaggatcatctcataatactcttgtaaggatgttccatgctccaagacagctgaccctatatgtaccattcactgcactgccttgccaagaccttgccaccagctgcctgggttgctttcttcatctaaaacctgcccatacctccatatttgtgccttcacagtaacccagaggttattagctagccttggaacttatatcacacttacttatttttttgaaacagagtcttgctctgtcgcccaggctggagtgcagtggtgtgatctcagctcactgcaacctctgcctcccgggttcaagcaattctcatgcctcagcctcccaagtagcgggactacaggtgtgcaccatcacacccggctaatttttgtgtttttagtagagacggggtttcactatgttggccaggctggtctcgaactcctgacctcaagtgatccatgtgcctcagcctcccaaagtgctgggattacaggcatgagccaccgcacctgccatgtcacacttactatctttgtcacatagttaatatatgtgctttatattatgaattctttctctgcatatatactttgttctttaattcaaatgataagttgatggagattacaagttgtgttgtatgatgttcattggcacaaacaggagcttgttcaatgataatacaagggtaaatgcttttgaaataggaaaatgggcctcactgctgaattcctttacaataatttgtgtgttctagaaatgagctctgatcaccacagggtgtcactgccttacaagtcaaattttcctcaattggttgaggtgtatataggaattctcagaagacattcttgagagatcacaacaaaatgtatagatagcaatgcagccattgggagatgtggagatgctataaaatcacatagaacaaaaagtgaaaatttaatttacacactctaaacatcccctgaaatcctattcttcttccctctgttaacaatttgttgtatagccttccagatctttcctccttggagagagagagacagagaaggacaggcacaagatttagaaaacataaatgagatcctactctccgtgagcatgtgtgtgtgtggttgttcagtatcttttttaatttgataacatttcatttgccatcttttttgtctcattacatccagctttatctcattcttcttagcagctaatgcagctatttctgaatattgaaatgatcagtaattgatgtctttaatctttgaaatgtttgccttgatatagtccaaagctgtgattcagactggatttcattctgttgctcattatgtgaacactatacagttaattagcaaacacttgggagggttggtaggtggtgtgtagtaagttggaaaacagtttatgcaagccagattgccaccagaatttagaacagcataaaattaaatgccctaggtaatttacagggagtaaaggggaaaagaccgagagaaagagactgttagaataccaatgcatttttgtgtctgcattattgtttgtttctgattgtaaaataatacatgctcattgtagaagatgggaaacagaaaaatgtattaagaagaaagcaaacattaccctaatcctacaacccagacttatccacagttaatatttattgttgctcatatagcttatttcctttttcaaaatttttattatatgatacaacattatgattttaaagcatttaaaacagtacaaaagggtataaagtaaaaatgaaaagttctcttcccaccatccctggtcctcactttccacaaagtcattcactgttaacagtttctctcataatgtacatttaagtgtattgatattggctttattatgagtatacaaatgtatggtgtgtgatctatataccataatggggtcatactgcgttaatttttttatactactttttttccatttagctttctatcttgagcatacatatcctatatataattcaaatacaacccaaagattctgggcatggagctatttcaaaaagtttgacctgacactgccccccatgccattacatgcccttgagtttctaaccttacacaaaagacctgtagccttagctgagggccctttccaatgaatcacacattcatcctgtgtatatatggctctattttattttattttatttatttttttgagacaggtctcgctctctcctaggctggagtgcagtggcgcaatctcggctcactgcaagctccgcttcccgggttcacgccattctcctgcctcagcctcctgggtagctggaactacaggcgccctccacgacgcccagcttatttttttcatttttagtagagacggggtttcaccgtgttagccaggatgttctcaatatactgatctcatgatccgtccgcctctgcctctcaaagtgctgggattacaggcgtgagccaccgcaccggaccatatggctctattttagactgtttggtaggagatattagaggaacggatattataaagtgccaaagacctgagtttagatcccagttgtattggttgctagctatcttttaaaaataaaatgttttgaacaactttgtgatatatttttatcctttagagatgagaaaacagagaccaagccagggagaagtgattatataagatcacacagctagtttgtagtagagccggatcacacaaaggcctatttgaacaagaggctatgtgcttcccactctaacatcttggactttctttagaactcctgtaggtaacaatgtattgtattattgaaaatcaatgagagagtagatttcaagtgttcttaccacaaaaaaagataagtatataggtaatatgtatgttaattaactcgacttagccattccacaatgtatatacatctcaaaacatcatgttgtacatttatacagtgcttctcaatcaattaattaacttaaaagatttacaggcatatgccttcaaggttattgcctagccttttcactaaagccttgatacgagttatgtattctattatctttctagtatccgatcatcctctctctgattctcttttttttgtcacattccctttttaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacttctccactgtccagacccgtttttttcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaagtttggttttcagacagtgctggtgcttctgcttcttaagttcatcaagggaatgaggagttcttgtccttctcctcctcttttttttcttttccactttctccttcaggattaaagattttgctgcacaattgttatttgttaggttaaatttggacaaatattcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatatt

SEQ ID NO: 5694 - DNA, 51622 bp, human
ccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcggtaagtgactctgggactaatacccacccactcccacctctttcgtctagattctatccccctcccagtccccctgctccccccacacaccccacttggggtttcagcagtgggggcgggagcggaaggttaagaacactatgtggaatcaaatgaaactcaagggaaaatgactttgctaaagggctgggcaaagaaaggccaagaaggagaggagagagcttggtggaagaagtgaaagggggcaagaatggatggatttgtctagtctagtctcccctggctcggcactcccaatactccttaagcggtaaggattgtctttgacttaaccccacacagccaaagtcacaaccagagagaacaggattcacaaggccaaagctcccaggtaaccccctgaagccatagcgggtacctagagaagcttctgaaaagaaggaggaggggacagtggtttaaggtgcaaagttaggctattggaggcacagagtgaggcctggaagcagctgcgggggaggagctgctttgggcgtgccagctctttaaggaggggctgagcttggttggagaaggaagccagagcctaggctctgctccggccctttaagacgtggccaaggcagttggttcgtctgtgtaggtggaagactgactgggccgagttgctgtgattgctgaagtgaatccatttgtttagccacttggcggagctgtctttttgtgggcttttttttttaaccctaagaatttgggaaaaaataaatcacatccaaacaggtggccaaaggcaccatgtcttatttcttttggtattatattcatcgtgaagaaacgcatttattaagcacctgtcacccagtgtggtaataattgagcaaaaagaataatctttaaatttggatttgaaactgatggagattgccatggtttggggtaatctgctttgaaaccctagtatcaccacttattagctgcatcaccctgggccttgcttttctcttccatagaatgcagattaataattctatctcagtagatactcgggtggatgaaatatcttgtgtatgtggcagaggctgccacttgtatcttagttcaacttcccttttctactcagtttggaactatttttctggaccactgctgataaaattagtgtttttctgtccttaaaacaccttccagatgtggtaaaacgaaacttaggaagactgaattagtttgtccaaaggctgaggctagaacacaggttttatttgcttctgatttaacattgtttccaccagacttcatcacttctgaaagaaagggctactagcctgccttttctctcattctttgggcaacttaaccagaatgatataaccaacaggacttttggacaacagaaacaagtgataggtaaatgacctcatcccattcttcagagttatggggaagcccttgagagttgttgacctttggtgactgctggggacacagagaatgggtggggagcaatgtcttcaggtaagcctggagggcagacaggcagaaaacataggaagagtagaaataataacctcaaaagtaaaaatgacaggtgcatctatgtagtccaccctcaagaccaacttacttaatggctgtaccttcagagccctcaggagctatacatccctcttgtttagacttttcagggcacattggaaattgggaaaaaaataaccatgtagcagactaccatcaccactctcattgttctaatacatgcatttctgaggtggggttctcattggctaagtgaattccaataaccaaagtagcaaacagagcctagtcatttttgatcttgccagattgtctgtgcctggtgcggtgggggcagtatatgatcttctaagatctagctttacaatgccatgattttgtgaatgaaggaaaacttaattaggatgattgacatagatgatcatctagtatgattaccatcttattgttaagtagagtatgaataagggaataacattgtagtattgggctcatttgtttattcaaagacagtgtgagatcatgtttggtattcttcctgatttttttttttttttttgacacggtgtttcgcccttgttgcccaggctggagtgcaatggcgtgatctcggcttgccgcaaccttcgcctcccaggttcaagtgattctcctgcctcagcctcctgagtagctgggattacaggcatgcaccaccatacctggctaattttgtatttttagtggagacggggtttctccatgttggtcaggctggtctcgaactcccaacctcaggtgatccatccacctcagcctcccaaagtgctgggattacaggcatgagccacgtgcccaacctcttcctgatttttatatgctaatgtttactatcctcaactgagtttcatcatttagcctgtttcctcatctctaaaatgacatgataatttgtgattataaataatgtaaggaaagcattgaactcagtgcctgatatctaatatgtttcataagttgcggtctcatcatttttgttatttaaaaaaatttgttttatttaaatgctgctgtgtgtttgcagaagtggaatgtagattagtggacaggaagctggatttaaatatatgaaaggtgctagatgttctgtataatatactaaaagatgttatttgtgtatttagacaaaatagatgtgatgtgggcaaactaagctctaggattattaaggagcaataacctaactcaagagcccaatccagatatttcaaatcactagcaatttgacattttgttgtaacctcacactcaccatttctaatatacagcccatcatcacctctggactcttcactcattcctcattcaagactcttcctttcacttccctggttctgcaacttactatgaccatagtaatggtgaacttatttaaactctgtactttagttgtcatatctgtgcattggggataataatagacactacctcataaggttgctgtgaggaataagtgtgttaattttgtaaacacttagaaggcggcatgaaagtgaagcagtgggaaaatgtagctgttgtggtactcatgtccctttcccctcttcctcattttctcatttaattagatgccaatggctgttgtattttttcccctttgtatctggtatctgtttctttattattattctaactgccaccaccttaatttaggcgagacgtgcaaacaattagcctacagaccaactaaagctcacacgtgttttgttttccctaaaatttaaaaactttcaactaaaacatgcattttcaattggtaatgcattccgcctggctcaaaattcagtatttactaaagggtgcatggtgaaaaaagtctccctcctattcctgttctctagccacccattttgcctcgctggaggcaactaatgttatctatttattaggaatctctccagggatatttagtgtatatcaagcaatgagtatgtttgtgtgtgtgtgtgtgtgtgtgtgtgtgtgtgaataacattgtagtattgggctcatttgtttactcaaagataatgtgaaatcatgtttggttttctatagatagatagatggatatatatatatatatatatatggttcagtatcttctgattattcaaaagaaactggaattctaggaatttaagtgaaatctgattttgaaatactggttatcaatcaacttttaaaagtgtgggactaggcaacttgacatactgacatgaactgaattgtgacccccccatcccccccaaaaaaattcatacattgaagacctaatacctaagcttgtgactgtatttggagatagggcctttaggaaagaaattaaggttagatgagctcatattatatataatacatatataatattagtatatatgtaagtaccacaacaactatattttctcactgcttacttcactttcatgccttcttctaagtgtttacaaaattaacacacttattcttcactgcaaccttatgaggtagtttctattatatatatatgtgtgtgtgtgtgtgtgtttgtgtgtgtgtgtgtatatatatatccccttcaccttttatacacagatagtaacacattctgcatattgttctctacaacttgcttgtctacttaaaaatatactttggagatattttcatatatgcacattttttaaatgcctcattcttttttatgactgcataggtttttactatatgcatgagccacaaatttttaaacagttttctgttgattgatctttaagttatttccaaacttttgcagtgttatttgtaataacaataaaaacttttgtaagcagtgcattagagagctcaggctgccataacaaaataccattgactgagtggcttaaacaacagaaatgtattttctcacagttctggaggctgggagtccatgatcagggtgccaacatggtcagattttcatgaggactctctttctgacctgtagaaggccaccttttcactttgtactcatgtgatctttgtacaaatgggaggagaaagagtgaattctctctggtgtgtcttcttagaaagacactaatcctatcagatcagaacctcacctttatgagctcatttaaccttaatttctttcctaaaggccctatcttcaaatatagtcactaggttaggtcttctacctattaatttttttttggagagtggacacaacacaagtcagttcatagcagtgtgtcaaattgcctagtcccacacttttaaaagttggttgattgccaatatttcaaaatcagatttcccttaaaattctagaattctaggccgggcgcagtggctcatgcctgtaatcccaggactttgggaggccaaagcaggaggatcacctgtcagcagttcgaaaccagcttgaccaacatggtaaaaccccatctatattaaaaatacaaaattagccgggtgtggtggtgcatgcctgtaatcccagctactcaggaacctgagacaggagaatcgattggacctgggaggcggaggttgcagtgagccgagatcacaccattgcactccagcttgggcaacaagagtgaaactccgtctcaaaagaaaacaaaaattcttcaattccagtttcttttgactaatcagaagatactgaaccagcattctctcttggcaataattgcctagagttgatgagcctctccctccctcccctttaaaacagtacttgtattttttgttcaccacattactcatctggcctaggtggccttaacctgtctgacccctagtctagatattgagattatggcacctatgtaagctcttaccgcagtactcatagaatattccaatagcttctagttctactttgattctttctgccctctctactctgaggaccactgcaaggatatattccttaaaacacttttaaaaattatgttactctccttcactccacagtcatttactgggtgtctacaaagttggaagcatcatgctagaagctgaggtgatagtggtaaacttaccactttaggttaggtaaactatcagtttaggtgggacccttgccttcatggagtatgcagtttacttttcctctcgtctggatttcctttctgtttcttcttgactgtcgtagttcttcaaagcccacctcaaagcaaaccatttatttgaaattttctctgactattccattctcagtaatctcctcctctcccaattattgctcatagcctcaaatcataatccagcaatgcagcatctattatcttgtaatatttgattgctattattttatgcataattgtttctcatcacacggacctgggatctcaaacttaaatctccagggcccagtaaaatgagaaaagcatgccctgtctaaaggggacagctgttgatcatctccagctaatttttcccttgtgccaatgtacactctgtattataaaatctctcagcttttttagaaaagcaagaaataggatttttttcttaaaacatgaaatctgcatttgaaaggttgttagatgtttctgttttaatctttaacatcactatgagaaccaggccaacatctgcagtgggctgccagttttctctatctgacctagactgcaaatttactgaggatagaggccagagaccatgaagttttcttccttctggtattacctcctccctccttcccacataatatctactacagtgttgactatttagtagggtcttggtaaagacttgattatcatcagaaagttcccctttaagttaaccatgatgtcctgtaaatgacatagtagttctactttctccaaatacctaaatgtgcctttgaagacaattatcaggccagctttctttttccctgtccccctttttgccagatgtaatcatctacatttcttgatctagctccattttgttttcttttaaaaaaattggttatttctctagtttctttcatttttttctgcatttctcttctatttgccatttttcttgaaatattgtacatcacaaataaagtacagtatcttcagaaaggtctacatgatgctgagcatatatttaagtttgattatttggagctaattattccatctcttgtttcttcctatacgttcaatgatgcggttgtttcatcttcagttagaatgggcggggatgtgatgtgaatatatttatttcttgtttgttaaactagttctgataaatatacataacagttggtgctaaaagaataataacatacttattccttaattttgtagctagatcctagaatagatgtgtagcgttgaattggctactgcattaacctcactttctggagctctacaaactgaaatggtccaagactcttctaggatgccttgtcttggtgctcctgagccactgctcaggcagtgagtagaaaagttattcaagagccaaggtctcttcccttaagtacctgttgcacaaaacatggatgaggaccaattgtattgttacaaattatttgtggttgccacactaccaccatgtttaatttattggaggagattgttgcatgaaataaaggtatgaagtaatgaagaggatcacatgagatgttacataatgattcagagcaatgagtttttgctgctgtggctctttgtcccttagtgccatgctggagttgtaattcctagaggttttgttttataattaacataataattagtgggaatcttttaatactctgtacatatattcaatattagagtttgctgcaaagatataaaaacaccttcattattattattttcaactctaacaaactatttcaaagtacagggtagtagcaagtactttaaggaaaaaaaaagagctttggtatcaaacatcatacctggattccaatcccagctcaataatttaccagtttatgtgaccttgggattatttaatcccattgactctatttcttcatgtgtatagtgggatcaacagtaatacctacctcacagggcaattgtgaaaattaaatatgtcccattagaaatgccatgaagtgtggcacacgtttacctatgtaacaaacctgcacgtcctgcacatgtacctcaaactttaaaattaaaaaaagaaatgccatgaaatgatatatctgggatttgcataaaaatatacattgaggtagggggagtgggttgaggtacagatgaaacaaggtttaccattagctgaaaatcattgaatctgagagtaggcgcatggggtttttgtctacttttgtatgcatttaaaatcacccataatttttttttgagatggagcctcgctctttcatgcagagtggagtgcaatggcatgatctcagttcactgcaacttccacctcctgagttaaagtgactcgtgcctcagcctaccaagtggctgggactacaggcatgtgccaccacacctggctaatttttgtattttttagtagagatggcatttcaccatgttggtcaggctggtctcaaactcctgacttcaagtgatccacccgccttggcctcccaaagtgctaggactacaggcatgagccaccgcacccagtcattcatagtaattttttaaatgccattggaatgagactcaagtttacctgatggtttgtagaaaacttaatccttcttgacatcaatctcacaggttaagcagaaacctgagatgattattatggattttccatctatgtccttgtaataaaatcatatatcatagaatgttataaactggaagggatctgaaaaggactaagtagtttactcaaaatgacactgctagacaacagtgaagcctgatctagaatacaagtctcccagatcctagttaaatgattttcccattgtttcacatggccttctttaatagtaagagttttatctgcttattgcatataagattaattattgtctaaacataaatatatttgttcaatggagattcaaggcaaggggactggttctaggcatctgagattatgtttctataatacctttaaatctgttttgtcaattgattcttacaagtatcttgtgaggtgaatgaggagttatttccactttctacataaagtgacgagacttgctcaaggtcacacaacaatttactgattaaactagaactaaaatgcaggcctggagtttattgagcttcatctccacttgtatttccagttttagacttttatcataattcctcttagctttcatctttttccagaatgaggaatcttaatctctagcacattccaaggtaatttttcattctggcgtatttattttctttttgtggaaaagaaaatgtagcttaacatcagcgtctgagagaagcgcaactggctgaaagcactggaggctatgcaggtgatattgtagaacatgaactcataggagaatggagataaagatatcaaaaatcatacataagtttgttactggaaatggtttacatcttaagtatgtgaccgtatttatgtacttttaaaatttttctgacagaagtaatcctaaaaacttatatggctattttatctttacatcttataagatatttttacatgtgttatcatgattggtcttcctaacagccatgagtggggagggctacactggtgtattcccatttttcaaaggagaaaacagacatagaaaggtcaaatgacttgcccaaagttataaatcccttttctggtatttcttatcaccttatattttcaataccttatatgacttcactacttcaagtttagctggctgttgtagtaatcatgtaatactagatttcagtctttctgtcactgtcgttcatacatgttatgtgctgccagccttcatttatttttgtggcaatatgttttctcctcttaaattctgttctttttaacatcctagtttgcccccacttccttttctctcattccaggtaagctaagcaggaaaactacaggggttttctggtttgtttgttttttctttctgctggaaagatacacgtaaatttagaattagtcagctggactcagtttagatgatcccaattttgttggcaacatccaaagcattgtaatcaggagccagtcgaacgtatgccttcttctctccatcaggtcaaatcagggtgttgatttgccacatcagtatcatagagcttcttcacagcctgtttgatctggtgcttgttggctttaacatccacaatgaacacaagtgtgctgttgtctcctatcttcttcatggccgacacagtggtcagcggaaacttggtgatagcatagtagtcaagcttgtttctcctgggggcactcctccgaggatatttgggctgcctacagagtcgcagtgacttgggccgctggaaggtgaggggtgtgtggatcttcttttttgtgtgtgtggttgtggacacctttcaacactgtcttcttggccttcaaagcctttgctttggctttgactttaggaggggcaggagcttccttcttccctttccgcgccatcttatcggggttttctgttttacagctacttctgagtacctgctgtggtggtggttcttataatttagactgggtacctcaagtcactctccagcttttgtgtatgttgaaactcttgcttttttttttttttttttttttttttgagacggagtctcactctgtctcccagactagagtgcaatggtgcgacctcagctcactgcaacctccccatctcctgtgaagcgattctcttgcctcagcctcccaagtagctgggattgcaggcatgcaccaccactcccagctaatttttatattttcagtagagacagggtttcaccatgttggccaggatggtctcgatctcctgacctcatgatccacctgccacggcctccaaaagtgctaggataacaggcatgagccaccacgcccggcccaaaactcttgaatagaaaagtcatacagagctgcctgctgaggtgctacaactggaaggtgaggttgagttttccaatggtgacaggtgtgagcctgtttgggggaaatgagataaattggaggcttttgcaatctccctttattaagtagttggtttatagcaaccatttattctctgctatggaatctgcttaaaacagaagctggaagatcctactggtacccaggtaatttcattatagctgctttatgtctccagactactgaggtttaaatctcctctctgctgtttactaacttggtgatttggtggtaagcaacttcatctctctgtgccttagtttcctcatttttaaatttcattcaattcaatttaatttttattttctgtttttgaaacagggtctctctgcacccaggctagactgcggtggcacaatcatagctcactgtagcctctaccttctggtctcatgtgatcctcttgcctcagcctcacacaacaacatgcctggctaatttttaaatttttggtagagatggggtctcactatgttgcccaggctattctcaaactcctgagctcaagttatcctcccgccttggcctcccaaagtgctggaactacaagcatgagccactgtgccaggccctctttcttcctttttaaaatgaggaaataatggtgcctactactagggttgtaaggattaaatgaagatatctatagatagataaatagatataaacagaacagtgtctgacacaaagtaagcactcaatgaatgtcggctgttatagttctttttatcaccattccattattaatgtcatgctgcagagatatcctgaaggctttcccaaaggcccattgcaacactactcttaattcctctggaagatgtgcaataaaattgtctgaaaataaatgtgtactgtagtctttctcaaaacccttaagcattgatttttatttttaaatagttccagtacttcttataggttagaggccaaagatgaatgatatctgcttaagatcttcctaagtgattagttgtgttgtccttaaatgtgttcttcttttagcagacagtttttcagaaagaaggtgctcaccagatttgaggtattagaaaatggttggggagcactataatttgagtcagaggactaaagtttcagttctgattctagcacttctaaactatgtgatgtcaggcctccaaatttattatgtgtgaaatggaaattatatgaaagctgtgtatttccttactgtaaagctatgttgatgtatataagacattatttgaattgtccaaatgctgtatcctgtcaaagcacaaggtctttcttaggcccgggtcagggtttccagtgctctgctttctttttagttgtaggttctaatgactctgctttgcaccccttgtcactttatctctaggcatttttccctttcagggttggccaaaggatgggatgttttcttcttagccagcacctgctccagttccttggaggcactgttcacttttgtaagacaagctgatcattataggaaatgccacttttgtataatataaacttggggacatgacaaaagttacataattttatcaaactcctgtagtcacagtacctggaatgtggtttgtgatgtcctgcatatatgagacattgacccactggcgatgggactcaatcttcttccctatttcttcctcctctgtttccttctataggacccatgcccttaggagaaggaccagaaagtccagcttgtagacacaaaggcttgaagagccaatccaagcagaataatggttattacctcaagttggtaatttgcatttctggtgtcctcctgcctgagtgattcacatctcaatggcccaggccatatatactataacccccttttgtatatttccttaccacttccctgacagcttttgtgcagctgtctggtctctcttaggcacttagagcagaaattccaactctagagaagagcaagaggctcataaatccctcttcaaaaaaaaacagagccttctttaagaccttctgtgggccttaattttcttcagttttcaattttgcctgggtaaatattttttaaaattaaatttaaaaaaggaggttatataccttcccagtatctttccttatagtcattcctaccaatatttagaaggttgaccaggattacctaatggctattccatttggctgttttctgggtgagggcactagccagaaatggctgagacattattaattgtcagctctccctcttatactattttactaaaatatttgtgatataggagggccaagaagtatttttcaggctccttgattgttgctattaaagcttttgaagatgggcagttatagttctggatatggctctatctttcctcatttccctgatcattcattcctttattcactggacattagtacatagtgtataggagatgctctgctaaaagatagggatacaaaaaaaggaacaagactaggtaactattgaagggctcacctggtggtgaaggaaacggacagttcctctttgtgccaggtactgttgtaaatacttgaacatatatcaacttgatacatcctcatagtaattctgtgacctggtactataattattcccattttacagatgagaaaacagacacaggaggctggaaaaactttgcccaacttcttactgttaagaagtcacagaatcagaatgtgattctaggcactcactccagagcccacatgttttactacactttgagagcaatgtggagtattgaccagaaggggaaggaagtgactatgaaatgatgaagggctagatttaagagatatatctgcaggagaattattatagctgataaccaactggctgaagatagggagagaggagtcaaaggtggctgacccctaggtttttagactgatagactgggtttatggtggtgctagaaattaagattagaaatataagaggtggagcaggtttgtgaactcatggggtataaaagtcctatttgatacacaggacagattctttgggccagagttcaagattctgataatcaacaataataatggtggtgataatagctaactgagagtgttctatatgccaggatttgttttaagtgtatttacatgtacagttattcatcccttaatgaaggggatatgttctgcaaaatacatccttagacaatttttacattgtgtgaatatcatagaatgtactaacataaacctagatggtataatctactacaacctaggctatatggtatagcttattgctcctaggctacaaacttctatagcatgttactgtactggacactgtaggcagttgtagcataatggtgtatatttgtgtatctaaacatagaaaaggcacagttaaaatatggcataaaagattttaaaatggtgtacctgaacaccacttaacatgaaggaaacttgcagaactagaagttgctctgagtaagtcacttagtgagtagcgagtgaatgttaaggcctaggacattactgtaccttactttagactttttaaacagtgtacactaggctacactaaatttataaacaattttttcttataaattaaccttagcttactataacttttttagcttaaaacacaaatcctgtacagctgtacaaaaatattttatttctttgtattcttattttataagcttttttctattgttaattattttttttttgctttttacaagtttttgttaaaaactaagacacaaagacacatcagcctaggcctatgagggtcaggatcatcaatatcactgtcttctaccttatatcttgtcccactggaagatcttcaggggtaataacatgcatggagctgccgtctggtatgacaacaataccttcttctgggatacctcctgaaagacctgcctgagaatgttttataattaacttttttttagtaagtagaaggagtacactctaaaatgatgatagaatgtatagtgtagtaaatacagaaaacaataacatagtcatttgttatcattgttaagtattacatactgtatataattatattgactgacagcacagtcgatttgtttacaccagcatcaccacaaatacatgagtaatgctttgcactgtgacattacagcgggtatgatatcactaggtgataggaattttttagctctgttataattgtatagaatcattgtcgtatctatgagaacacttggacacaggaaggggaacatcacacactggggcctgtcatggggtggggggagagcggagggatagcattaggagatatacttaatgtaaatgacgagttaatgggtgcagcacaccaacatggcacatggatacatatgtaacaaacctgcacgttgtgcacgtgtaccctagaacttaaagtatgaaaaaaaaaagaacagtgtcgtatctgtgggtcatcgttgactgaaacgtcattacatggcatatgaatgtattaacatggaatgttcacattaactctgttaaggcaataccgtgttaccccctcttttggcaggtgaagaaactgaggttcatagaagctaatatagcctctcagaatcactctgcttcctcaactctgctgtctcttaatccataggaatcgaagaacagattggagttggctgtcttaagttgtacttgctagaaataatgaagcctgttgaaggtgttgtgtgaatgcagagggagaatcgaatcttctccactcctacgcatggttctggcagcaacaaagaaagctctcctggcgttttggtgcccccctgtgggctgtatgagagttacctgacctcacattctttttccaccatcacacctccttttcctgtcttagaaatcagaaaaagcttagctaccctctctaccacctctcacttcatagttaattacacctcaggcatctttcatgcataaattctctaattttctttcgttcttttccacccttttccaatttctgtacttgagaaaacacattccctcactctccttttctgtcactgtcatcaaaaaccttcgaaaatgtgattaaacacctaccatgtaccaggcaatgttctagggccttggaatacattagtgaaaaaaacaaagatgaaagtatctgcctgcaaggagctcagattctattggaagtcagttttcttaattctggcttctactattcttattacttactacagttcctccattaacctgttaaaagagaaactttagacaaattacacttaacagtttaatcgagcaaagaatgattcatgaatcaggcagcccccagaagaaataatagattcagagcaactctggggctgccatgtagtcagataatatttatggacagaaaatggaagtgaggtacagaaacagctggattggttatatctcagtatttgccttattcaaacactttgagttgttgactgcctgtaattggctgaaactctgtgattggcgcaacagtagattacactgtctacacatccagttaggttatggttcattatggatggggaaacctttaggctgaacttgaaatatgtaaggaggaagctttaagctaaccttaatttaacaaaccccacccccaagttccatggaagccttagggttctgcagaggatagtctgaaatcttttaatcatagatggacaagttgtggcttaggaaaaaaaaggccttgccaaagattatgggatgtgagtgctgcacatctaactcccagaaaatctggttgaggaagaaagctagtaggtgcttctagtatgaatgactgatggtttaaggcagctgaattaagacactaattcctttttttaagaggaaaaactaaagaagaaagagaaaactgtttttattaccccacctggcttgcagatttaagagacgtagacagataaaatacgtctctagagagatttggccttgatgtgtaaataagttcactcgggtaaatatatatataggagcttggaactccttcaagcaagaactagaccaggaaggtagaatactgaaaactgtagctatactgatgttcctctgaaggcagagcatgttggagaaataggaagaaacagattacctgcatgcagtttggtggaggggagcagctaatattattggggaaaagttaggtccatcttgatgagtaaaataaatcagaaggtttcaatgacttatcagtatctggtaagcactgaaagataaaggtcatagaacacacataacattaatggcatatttatgcatatagtgggttagattttattctgaaagttgtcttttccttttctcttttccagatatggataaactcataaacaacttggaggtccaacttaattcagaaggtggctcaatgcaggtattcaagcaggtcagttatcaggaaaatagggtgctaatattgggccataatagtattgaatacctggtagtgattacagaatttaaactcatttttctttctataacatgtttggggattgagaagaggtgaaggaagacatatttctagaaagtatatgaatgccttggtttcatagtcagctggggagtagatctggcctaaaagaaacatagcctctggaatcaaggctataaagacaagagtagacctttagtagacaatagcaactatttatatagcactatttcatatttcagataggatgaagattaaatgcattgtcttatttaatcttcaccataatcctgttgaacagtgtattaattagtattctccagagaaacagaaccaacaggatatgtgtgtatggtgtatgtgtgtgtgtatgcatatatgtacatggagagagagagagagagagatttcaagaaattggctcattagattgtggaggcatggcaagtccaaaaccccatcaggggtaggccggcaggctggagattcagaaggagttacagtttgagtccaaaagcagattgtgagaagaattctttcttgctctatggaggacagtctttgttttaaaaactaaggtcttcaactgattggttgaggaccactcacattatagagagtaatgtgccctatttaaagtacaatgttttaaatgttggtctcatccaaaaaaataccttcacagaaacatctagaataatgtttgaccaaatatctgggcactgtagcccagccaagttgtcacataaaattaaccatcattattcttagtttccccatttgatggaaaataaaactggccttgaacactccaagaattaggattcgaaacaggttatctggattttatgtcccagggctctgtgctagatgttgaagtcccgtctttcttggggttgcaaattcactgcatgagtgaaactcaaatacagtcaaaattaaccttgaaaatccttaaatcacctatagacttgagtatacagtgttgtatatacaatacttgtctgtttctttatttaattcatcagataaagttggttacatttaggaatctttttgttataatttcaacttttattttattttttgaatttttatatatttatttatttatttatttatttatttgagacggagtctcgctttgtcacccaggatggagtgcagtggcacaatcttggctcactgcatcctctgccttccaggttcaagctattcttctgcctcagcctcctgagtagctgggactacaggcacgcaccaccatgcccggctaatttttgtatttttagtagggacagggtttcaccatattggctaggctggtctcgaactcctgacctcatgatccgcccacctcggcctcccaaagtgctgggtttataggtgtgagccaccgtacctggccttatttttaatttttgtaggtacatagtaggcgtatatatttatgggatacattgagatgttttcatacaggcatgcaatgtgaaataatcacattatggagaatggggtatccatccctgcagcatttatcctttgtgttacaaacaatgcaattacactcttttagatattttttaagtgtacaattaagttattattgactctagtcaccctatcatgctatcaaatagtaggtcttatttgttatttccaacttttttttgtttttgagatggagtctctctctgttgcccaggctggagtacagtggtggcttctcagctcactgcaacctccgcctcccagattcaagcaattatcttgcctcagcctcctgagtagctaggactacaggcacatgccaccacgcccagctaattgtttgtatttttagtagagacagggtttcaccatgttggccaggctggtctcaaaatcctgacctcaggtgatctgcccatgtcggcctcccaaagtgctggggattacaggagagagccactgcacccagacaatttctaactattttttcgtacacattcaccatgaccacctcctcctcaacaccccactgcccttcccagcctctggtaaccatccttctactctctatgtccatgagttcaatggtttcgatttttagatcccacaaataaataagaacatgtgatatttgtctttctatacctgacttatttcactgaacataataatctccagttccacccatgttattgcaaatgacaggatctcattctttttatggctgaatagtactccattgtgtatctgtaacacattttctttatccattcatctgttgatgaatacttaggttgcttccaaatcttagctattgtgaatagtgctgcaacaaacatggaagtgcagatatctctttgatatactgatttcctttctttttggtatatacccagcagtgggattgctggatcatatagtagctcaattttcaatttttttgaggaacctccaaattgttctccatagtggctgtactaatttacattcccaccaacagtgcacaagtgttttcttttctccacatcctcaccagcatttattattgcctaactcttggataaaagccattttaaatatctcattgtagttttgatttacatttctctgatgatcactgatgttgagcaccttttcatatacctgtttgccatttgtatgtcttcttctgagaaatgtctattcaaatgttttacccatttttaaattgaattattagacttttttctattgagttgtttgagctcattatatattctggtgattaatctgttgtcagatgggtagtttacaaatattttctcccaatctatgggttgtctcttcactttgttgattgaatcctttgctttgcagaagctttttaattgatgtgatcccatttgttcctgtttgctttggttgcctgtgtttgtggggtattgctcaagaaatttttgcccagaccaatgtcctggagattttcccaaatattttctgcagcagtttcatagtttgaggtcttagatttaactctttaatccattttaatttaatttttgtatatggttagagatagggttctggtttcatttttctgcatatggatatccaggtttcccagcaccatttattgaagagaccacgcattccccaatgtatgttcctggcacctttgtaaaaaatgaattctttgtagatgtatggctttatttctgggttctctattttgttccattgcactgtatgtttgttttcatgccaatacaatgccattttggttactatagctctatagtataacttgaagtcaggtaatgtgattccttcagttttgttctttttgcttaggataacaggctattctcggtatttgtggtttgatataaattttcggatttcgtttttctatttttgtacataatgtctttttttctttttcttttttttttttttgagatgttgtctcactctgttgcccaggccggagtgcagtggcacaatcttggctcattgcaaccttcacctcctggcttccagcaattcttgtgcctcagcctcccaagtagcagggactatgggcatgtgccaccatgcccagctaatttttttttttttttttggcagagacggggtttcaccatgttaaccagactggtcctgaactcctaacctgaagtgatccacccacctctttgtgttcccaaagtgtgtcaacagtgaacaatctgacaaagcaacactttgcttcccaaagtgttgagattacagacatgagccactgcgcccagacaagaatgtcattggtattttgatagggattttattgaatctgtattgtgttttaggtagcattgaagcaggatatttccttgaccccttcgtgggtgggaactggagtgcactggtgctggacctagctggcgctttggcactagcaggggcgaattccactcacttaaacctgctgtgttctaccccttgtgggaggggaatcacaggtcagtgggtgcaggagctggggtgagtgcctttgggcaccggcaggagcaaaactctatgcgcaccccacagcagagtccggggggcggggtgcctgcgacccttgaagccccagaaggagtgttacagtacccttttagctttgctgtttgcagatggcttaagcattaacagctcaccagagggtcagtgtgacagccttctgcacccacactgaagttcttgtctggcatccaggaggaatgaggttacacaatgaatcaaaggtggttaatgtgggagattttattgctgatcaaagtggctatcagtgggagggggagctgaaaaggggatggagtgggaaggtaatcttcccctggattccagctgtccccatctggactcctctccaaagctatgccatcaagctgtccctctgaagtcaagccacttctctccaacatccaactataatctccaacgtttagctgcttctcctctttctgccagctgagcctgggtttttatgggcacaggatagggggcagggtcaaccatgggtggttttggaaaaggcaacattcaagcaggaaaacggaaatataagttctcactttggactgtggttccaggcttcagggtggggccctcaccagggacctgcccacttctgcctagaatttccctgcctcctgtccctgtcagtatggacatttcaacaatattgattcttccaatccatgaacatagaatatttttccattttttgatgtcctcttcaatttctttcttcagtgttttatagttttcattgtagacatctcccacttctttggttaatttgtaggtatttaattttatgtgtggctattgtaaacaggtttacttttttatttctttttcagattgttcactgttgacataaagatgctactgatttgattagtttgattttctatactgcagctttactgaatttgtttatgggttctaatagttttttgtggagtttttaggtttttccaaatataggatcatatcatctgcaaacaaaaataatttgacttctttttttccaatttgaatgccctttatatctttctcttttctgatggctctagccaggacttccaatactatgtggaataacagtgttgacaatgggcatccttgacatgtgccaggtcttagaggaaaggctttcagtttttccccattcgatatgatactagctgtgggtctgttttatatggcttttattatgctgaggtgttacttgtatccccagttttttgaagggatgttgaattttatcaaatgctttttcagcatcaattgaaataatcatggtctttaatccttcattctgttgatattatgtatcacattgattgatttgtgtgttgaactgtctttgcacccagggatcccacttggtcaggatgaaggatctttctaatatattgttgaatttggtttgccagtagcttgttgaggatttttgcatcagtattcatcagagatattggcctgtaattttctttttttgaagtgtctttgtctggttttggtatcagggtaatactggccttgtagaatgagtttggaaatagttcctcctctatttttcagaatagtttcagtagaattggtatgagctcttctttaaatgtttggtagaattcagctgtgaagccatcaggtcctgggcttttctttactaggagactttttattatggcttcaatctcattacttgttattggtctgttcatgttttggatttcatggttcaatcttggtaggttatatgtgtctaggaatttgtccatttttttctagatttttcaattcattgacatgtaattgctcatagtggctactaatgatcctttgaatttctgcaatatcagttgtaatgtctcctttttcatttctgatattatttatttggatcttctctctttttttctcattagcctggctaaaggtatgtcaattttgtttaacttttcaaaaaacaactttttgtttcactgatcttttgtattttatttcaaattcttttaattctcctctcatctttgttatttcttctactaattttggggttggtttgctcttgtttttctatttttttttccaaaagaatatgcaggtatcattgcttttctaggtctttaagatgaattattagattgtctgtttgaagttttttctgtcttctgatgtaggcacttacagctataaaacttccctcttatgactgtttttgctatattccataggttttgatatgttgttttccattatcacttgtttcaagaaatttttcaattttcttcttaatttcttcattgactcactggtcattcaggagcaatttttgttgtagttggtttttttgtttgtttgtgacagagtttcactgttgttgcccagtctggagtgaaatggtgtgatctcagctcactgcaacttctgtcccctgagttcaagtgattttcctgcctcaggctcccaaatagctgggattacaggcatgtgccaccacacctggctaattttgtatttttagtagagacggggtttctccatgttggtcaggctggtctcgaactcccaacctcaggtgatctgtctgcctcggcctcccaaagtgctgggattacaggcgtgagccaccttgcctggcaggagcatattttttaatttccctaattaagttaaagtttaataatattattaaacattaataaattaatgttttataatactactggtgtatggtgtttgtatagtttcctaaattcctcttgttattaatttctagttttattctattgtggtcagagaagatgcttgatgttatttcaggttttctgagtgtcttaaggtgtgttttgtcacctaacgtatagtctgtcactgagaatgatccttgtgctggggaaaacaatgtgtattcttcggccattggatgaaatgttctgtaaatatatattggatccatttggtctatagtgcagattaagtctgatgtttctttgttgagtgtcttcaacttttattttagattcaggggatacatgtgcaggtttgttacatgggtgtattgtgtgatgccgaggtttgggatatggatgatcttgtcaccatggtagtaagcatagtattcaatggtttttcaacccttgttctcctctctccctccttcttctagtagtacccagtgtctatttttgccatctttatgtccatgagtacccaacgtttagctctcataaataagaacatgcagtatttggtttcctgttcctgcattaattcccttaggagaatagcctctagctgtatccatattgctgcaaaagacatgattttgttcttatttatgtctacatagtattccatggtatatctttaccacattttcttgatccattccgccatcgatgggcgcttacgttgatttcatgtctttgctattgtgaataatgctgtgatgaacatataagtgcaggtatatttttggtagaatgatttattttcttttgtatatataccgagtaataggattgctgggtcaaatggtagttctgtattaagttccttgagaaatctaggagtcagttttaaaaattgttctcaatcattgtttggcccatggtgtataaatgaatttgcttaagttgcatatgcatatggatgagaatcctttgtactgttttaatgatatttagccctatttgatgtcccatttaccttaatcgtagcttttgcatttaggaattattagcacatcaaaacttgctaattgttggaaaacttctgcctgttgctagagcttactcatagttaataccaagaggaagctgagtataagtagtattagataaaaatctattgtacttgtaataaaaaatactctatgaaatgtcattgagcgtgcatagctacctttgttgttgttgttgttgttttgagatggagtcttgctctgtcacccaggcttgagtgcagtggtgtgatctcggttcaccgcaagctccgcctcctgcgttcacgccattctcctgcctcagcctcccaagtagctgggaccacaggcgcctgccaccacacctcgctaattttgttttgtactgttagtagagacagggtttcaccatgttagccaggatggtcttgatctcctgacctcgtgatctgccagcctcggcctcccaaagtgctgggattacaggcgtgagccaccgcacctggccaaagctaccttattttgagatctcagtgtacctaagtataattctagaaatgtttttctatgcattctttaggtatactgaacttccagaatttggaggcactttgaaattggttcaatgtgtagaaaagtctggatagtaagggatctaagcactttttttgtttgtttcttggcatttccaggatatcttatttttagaaaagcctgagtgcttgtgatacatggccacagcacactggccatgtctcaggtgacaaggaccaggagtttgtgttctataactacgcaatgctggcatcattctagtgtggagaagcctcctggtttgattcattataggatttgtttatttcaaaagttaggactagtgggtgggtgtgtagctcagggcacacatgctgctctcccttctctaaatttctgtatcaacataccatgcagtgaaagagcatttggttgtcacctgccctttatttttcgtttctgattacttcctacaagtgggatgtcttggtcaaaatgtatgagcagtgttagggttaaattttatcatacatgtctctcctttaccctaatttaatattgttaatatttggcacatattttcacacagcctaattctctctctctctctccccccattttattactattgtaagttgcatcaagaaactttacccctaaattattctgcatgcatcacctacaaataatgacattgtcctacataactacatcagcactgtcacgcccaagaaaatgaacaatatttccatgatactatctaactggctcatacctttcttttttttcctctctttttttaaagctgggctgctttctcagggttcatacatttctgtgccacttttccccacactgttttttctacatggattgtgcctcagtgagctagtatagctcaccaaactctttacttttcttagggttcaaattccaattctacctcttccatgaaacatacatagaaaaccccaactgtctcgaatctctagtgaaatcatgctcctggaacactaaattatctgtattagtcactaatgtggtacctgttctctattgtcaactgctttatgtaaatatctcttgtctccccagtaatattttttgtctcccaaacttcaattatttacttaccactttcacgatttttgccacatccttgccatcaatattatttacatactttaaaattatttaaataaataaataaataaatctatattagttttgtcctaagctatctggagaattctcggtttgatgtgaagtattactttcctagaattgctgaaacaaactaccacaaactaggtgggttaaaacaagagaaatgtgttctctcactgttctggaggccagaaatctgaaatcaagttattgtcagggtcatgctgcctctgaaggctttagtgaagaaacttttccttacctcttccagcttctggtacatataggtattctttggcttgtagccccatcaccccactgtcagcctgcatcttcacattaccttctcctctgtggctctgtgcgttattcctctgtatgtctcttataaggacactagtcattgaatttagggcccacccagataatccagcaggatctcttcaagatctttaattacatctgcaaagatactttttccaaaaagactctgggaattgaggtgtagacgagtgtttttgagggtcaccattcagcccactacaatgtgttatatatattttccaatgtacagtacaatagagtaagcataaatattaaaataaaataacttcatccatgtattacccaaaaacaaccttagattctttgagaaacaaaaactgatttagtatttttcacattttctatagttttgtgctaggtactaagcaaatacctagtgaacaaatatatgcatacatatacatatgtacatacatttgtacatttatgatctcattttgcctgattgtggctactaccatcccaatctcttaaaattgccgggtttgttagattaagtctaggtttctaataatacccatctccatccaccgctccattttctaatacccaaacagataatgctcttattggaaaaagaattgagttttagaaggttaaacagactttttgacctaaacatgaatgtgtacaatacatgtgtgcatatgtatccaggcataaaactaattggtttaacccagagcaaagctggaaggtacctgtttacaaaaacaggtttcctctttctgtttgggaggagcctaggctttatcgtgtttctataacatcccttcctctccttccacctactgtgctgtatatagtattttgttcttcatttctaatcttgcattaccactttcaagctccacatcagagctgtttcaaatacatgaaaaatggaaactttgtaacagttgattccactgattctcagggcctctctacctatcttaatcaaatgcttaaatatttgtgaaattaaccaacttttctcagagtttatttctagaattgagaggggtgtttcctaagaaccgaaagggtctcatctttagtaatatatgaataaataactctttttatatttttttgtccactcaaattggcttaaggaaacctgataaggattctgggtatttgaggagtagcactgtggaaattaaagcttgtcttcaaaccacccctaagtttctttgttttctttcatgcacaaccttcttcatagattcagaaatccggaaattcaggataaagtcttaaaatagcaaatggggaaagtagctattctctttgatagtgattgactagagaacacttaaaaactgaagccatcacaccacactaaaaatgaagaaagattactttaaaagaaaaatctgatgacagaacaatcctcagatgagtttcaaagctgaagtgattatattcaatgaagcatgaaataggtagccatcctgagtcatcttagtgaggattcttaaaatcaccaaaattctagggacaaaaactcactcaatcaagacttgaaggtcttcttcagaaccttcaagcataatatgctatctataaagataaggtaaagcaaatagggtgttggggttttttttaaccatagggagggttatattcaaactatggaataagttagactgtataacaatatttttattaaaattattttgatcatattgaaaaaagaatcctcagtgcacacaaacaaaacttattcaccctgatagtgtgtagatatggaatgcttgtctttaagccacaaaggaaggaacagtaaggtcaaccttgagacctacttttgagaacagtctgttttcttaagaaagcttgcattcagaagacaatatttacacccagaaaatacttgctacaagatagattcacttagacataagaggcatacttgggagtgatatgtacagaaaaaagtatgtgacactatgctttgaggaagttactattaagatactaaaacccaaacaactccccttccaacacttctctcaaagccttttgatggcaggagagaagtaatgattgaagccctgctgcagacagggtttggttaagaattggcaaaccacaaaataggtttagtctatgaaaggacaactaatgatggcctgttggagcaggaccctgtaacactgtatctcatcaaggcaataagaataggctatcagttcttcagtttcttgactttcatcaatcagtttccattttagatgttcctacgtaatgtttttcaataaaatgcatacctgcagatcaagtatcagctaaacacaaggccttgagctagtaacattgttgtaggcagcactcatctcactgaaatggcctttctttggcaaaagagagtaaaagttgccaaagtcgtgtttattttatagttaggattcaaagcttcagctttttcaggtttcttagtccaaaaagtccctaaaatttagctaaatcttttcttaatttcagtggcaagttgtgtttatttatacacctgcacccacaactatattcttacagaaaatgatattacagtgaattattattattattattattatttttgtgtgacagagtctcattctgttgcccaggctggagggcagtgacaatcctcctgcctcaacctccagagtaactgggactacaggtgcatgctaccatacctggctaatttttgcatttttagtagagatggggttttaccatgttggccaggctggtctcgaactcctgacctcaagtgatccacctgccttggcctcccaaagtgctgggattacaggcatgagccaccgcgcccgccctacactgaacctcttcttatgctttctattgtaactctatttctcactgttattgacagcaatgatagactatggaaagagataacattttttcttttgaagattccttggattctatctttttaatctgggaatggagctactcaagtgaagagttatgtgggaaatgtaggaaaaataagagcttaagttgatttgggggattctgagaacaggggagttttatgttcagcagagccaatcttgacaacttcctctccctgtcaacaggattctactccccccttatctggatgggtcaaatccacccatgagggatgggttacatttgcagtatgtgaaacagtgggacaaatcacagaaatcatgtcctggaggagcagattgaagcaatgtttggaccacaaacaagggctgagttgggataggtgctggcaaatcaagaaaccaagagtgttgtagcataaaagaagggaaaagaagatggcagtctggccaaattctggagacaaagcacggatgggtttttggtgccgttactcattcccagcctgctctgagcattgttgtcatgtgtttttgacgcagagtcttgctctgtcacccagactggagtgcagtggtgtgattatagatcactgcagcgctctgagggtttttaaaataaagtcagagcaagaagacactgcctcccctgccacttattgctctctgaattcagacccttattatctctcacctaaattttaaaaaatcataagcataacataattatcacaccttaaaattaactaattcattaatattgtccaatatccagtcaatactcaaatatttttacatgtctcatcgagatttttccacttgctttcttttgaatgtctttgaatctagttttattcctctttcaatcaatcttcattaagaagctagttaaatctcacagaaatagttcttcccttgttactcctctcttccaaacaattatcttctatcacccaacctttcattgaactctacctttcctcatcttccaaatatacaaaactaaaagtggttatgttttatataaaggatgtattccttaacatttttcataatttaaaactcccataattcaagtatcatgctgatagataatggaagcttgtttgtttactggctaaagaggtggtaccaccatctccaaaatcatcttcaagatccagagtgttgcttggcagtggcatacacagttcattatatccttgacctttgaattcatggaattcttagaaagtttttaattaggttgaggctttatttcatatattacatataaatgatcatttattagttttttaaaaaaagtattagttttttattaaaaactattagttttttaaactaataaatgtatttattagttttttaaactaatgtatttattggttttttaaactaataaatgtatttattggttttttaaactaataaatgtatttattggttttttaaactaataaattggttttttaaactaataaatttatttattagtttaaatcatttatgatcatttagatcatttattagttttttttaaaaatcccagaattaaaaagttgcagagttcaattttgcatataatacaactaactgtattgcaagtttatttcatagtttattctataattatactgtctgttgttatggctctatagacaggaatatctttcttatctcttatctgcctagaaaatttctattaattttctatgactcagctgaaatatcacctcctccttgaagccttccctttctagtcagaatgagtcattcccttttgtttttctaaaacgccttgcttgtatgcctgttacattatttattatggtatgatttataaactattcacattattctatcattatatttaatatgttggtatgtacttattggctgtactttattgatgtgtgctgccactgagcttatagtagatgctcagaaagtgttgactttaaataattttgcaagattattgtgaacgttaaatgaaataatttttaacaattgccggatacagtacctggtacttacagatagtaaagtttcccgtctgtttttctctttagtttactcctgccttatttctcccagcaccatgtattccttccatgtgaaatgaatagagatttcttttttacattgcttgcatgtctcttcagggtactaacactgacttatgcatctctcatttgtttatttatttaaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcaggtaagtaacaatattgcctctttcctggccttcctgaatctattcccttttagagtcatcctatctcctgtctcttttcacttcctccaattattcttgcacactgcttcaagagtaatctttcaaaagtactgttttttatgtctttttaatgcttaagaatgtacaatgagtcttgattagaccatgcttctcaaacaagtacaagtatgcatatctatcagtgacatatcaaacaacttcctggaacttccacattatttgatattaaataatttaagcattttatatttaaaatatgattatcttgtattacaaaatgcaaaatttaaaaacctgttaagataaaccacatgcttcaaaaatagttgaagcttactaaaggcatccaccctcggacttttcaggagaatgtgtttattttatgccattcagaatgctttggtgggaaagttgagaacaatatttctatctcaaacatacttagccagtattagctcctgcctctaccaatactttcccttttctcttccctacaaaagaagtaattgaaatattgtcatcttccctgtgttcttcctcatttggcatctatcactttccattttacttatttatttgcctgtatcacaagagtttgggcattattcacaactgaattgtaaattcctgaaaaataatactctatcttaatttttttatgtatgcctccagagaacttaacacagtgctaggagttgtcttgcaacagataatttgatgaacaaacaaacttgaaaatttgtccaagagagaattcaaatgctataatcttccattttattttatttttaaaataagttcagaattcagaaaggtataaattaagtctctcttccaccactatcccccaaccactagttttcctcccagaggtatatctgttttagtttgtaatcaggaatgatcaaggaaaattatgtggcctctaaagcaggctgataatgttttgcataaatcggaaaggccaaggggtggaaatgactaggaagcagatttcagcttactgtaaaagagtatctacccttgaaatttgatgccctgtactaaatgtaggaggctgaaaaacaacatactactaagcatcaagttgctgagactctgcactggtcttctgaatacaaatattattattgactagtggttaattgtggtaatgataagtgttcataatcttattttgagatgtgatatccattccatatatgaagggagagccaaacaaacaaaccaaaaaaaggaaacaaacaaaaaaggaaataaaattcctcgtgtgacagtttatgctgagataaaggcagtggtaacatcaaaggatggtttgaaggagctttgaatagtccccataatatcatcagtccatcagagccactctaaataaacaggataaattttaaatgtgctcaatgtggttccaagctaagggcattggcccaatggtgtctgtattagttcgttttcatgctgctgataaagacatactcgagactgggaagaaaaagaggtttaattggacttacagttccacatagctggggaggcctcagaatcatggtgggaggcaaaaggcacttcttacatggtggcagcaagagaaaaggaagaaagaatagcggaaagccctgataaacccatcagatctcatgagacttattcactatcatgagaatagcaggggaaaactggccaccatgattcaattaactcctcctgggtccctcccacaacatgtggaaattctgagagatacaattcaagttgagatttgggtgggggcacagccaaaccacatcagtatccaaaatggggggcttactaaaccttagggggcacatataaaacaattggagtgcaagaagaaagtatcaaaatttgtattttcttacccttaaaaattgacaggtaatattgtatgttttaatcatctatagcatgatgttttgaagtacatatgcattgtggaatggttaaatctagctaaataataaatgcattacctcattatcatttttgtggtgagagcacttaatgtccattctctttacaattttaataaataaaatgtatcatcattaactatacttgccttgctatacaatagatctcttgaaatgtattcctcctatctagctataattacgtatcctttgaccaatatctccccatccccctccccactagccaccccagcctctggtaactaccattctactctacttgcatgagattaacttttttagattccacatatgagtgagatcatgcactatttgtccttctgtgcctggcatatttcacttaacataatgtcctccaggttcatctatgctctcacaaatggcaggattttattctttgttataactgaataatattatattgtatatatatatatgtcacatttcatttattcattcatttgttgatagatattttaggttggttccacatcttggctgttgtgaataatgctgcactaaacagggatgcagttatcttttgggcatgtgattttatttcctttggatatatacccagaagggagattgccagatcatacggtagttctaattttaagtttttgaggaacctccatactattttccataaaggctataactagtttacattcccatcaacagtgtgtaagtgttcccttttctccacatactcaccagcacttactgtcttttgtcttttcgataatagtcactctaacttaagtgagatgacatactactttttgtttgttttcttataatgtatacaaaattgtaggataccgatacatgtatatcacatacatgcacaaacatgcacacctcaagatacatgcttaaaactttttagtgaatgatatgcaaagtatagagacaactcttttaaccaaatacttgttccccaccttatcaccacccccaagtttcttctctatagaaattttgaaggtttcactggatctaggagactgttgaccacctgattgagtttttaggaattagaaacatcaggggttgataataaggaatatttgacagcttctcccaacataggtggaaaggaaggttgtatcaagcacctactaggtggtaggtatacgtttcatctcattgacttatttctgtttaggagcacaaaggccaaggtggatgttctcacatctggactaatcctagaatttgattttaggacagccaggagctattcagtgagttcaattcaacacacacacacacacacacacgttgaaactaacttttcagctgaccctgtcctggtagctggagatagaaagatgaatcatacccagaccacatcctagagacactctcatttgataccactcatagtggtatcagaactcttcatactactcttactttaaaggcatttctgttccctgctatgcaaaaaaaaaaaataaaatgttattctcttccttccatgcaaatacacttctttcatcttgttttttatttctttatttttctgtcttgctgccacttcttaaggtgggacaaactgggaatcctgaaaatgattaaagaggcacatacatcttcagctcacactgctccctttctttgcttttagtgaaagttgaccccacctccatgtctccactggaaattccaagtgacagtgaggagagtacaattgagagtggatcctcagccttgcagagtctgcagggactacagcaagagtgagtactttttgtcttcaagtctgtctttgtgtatgtgtgtgtgtgtgtgtgtgtgtacatttgcacatatgtataggtggaactaatgatcagacacaagagtaagaatttgaggacaagaaatatagggagactgcctttccagtgaaagtatatgagtttgtgtgcacacatgtgcatgtacatgcatgctatagtagagctatgttctaactgtagatcatcaatttttcttttgaaaaatcttcaaatttcccataaagtgtagttatgtactgtttctctctgtaagtttaaaacagctttgtctttcaatattgaaactaattggaagtagttggcttgtgtttagcaacaactgttgtatgaaaaacaaatttctttaagcaggaaaatgaaacttattgaagtgaaatgctcacactgtttgggaacacaaccactgaaggaaacactaccacctcccatgctttctctgagcacctactgagggacctgtacctactgagcagaatggcctagttgacagaattgtttttactattccaattatttctttttggggggacctagcattaaattcacgtaaattaaaagccgatatgatgtggcaccaatgaatgtaaattcatttttttagccttcactttaaagtcactgtttggctttatctctatttctttgatcagaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggtctgcccactcccatctcacccccaacacacacacacacacacacacacacacacacacgagagagagagagagagaggggcagagagagagagagagaggggcagagagagagagagaaaatttctgagagacagagaatgaagtcctgaaacaaagactgatgcatttatactcatgggcacaggctccattcatggtttttatccctatttcttgtccctactctaaggcagattttataaaactggcctaggaaaacactaaactaaatctggtgtcttaatagtcatcattcccagtgagccctgtgggtctttctaattgcggagtcaacacttaagcaaagattaaggcattactcccttccttactaccagggtctcacaagttttactaagcatggaaaagcacaagaacaatttaaactatgtgaaattaaagcaggttgtaatccactaaccattaacgtgtctttgttcacattaaaaaaaaaaggtgcacataaataaataaagcagacctggtagtgatcctgtcaaaccgaacagcacatacctgatctgaagaaggagagctgccactcaaatccatgtagtcagccatcaatattcttaggttccacatccgtggattcaaccaaccacaaatcaaaaatattttttaaacaacaaaaataacaatacaacaataaaaaaatacaaattttaaaatacagtataacaactacttacatagcatttacatggtattaggtaacgtaagtacatctagagatgacttaaaatataggagagaatgtgtatagattatatgcaaatgctatgttattttatatcagggacttaagcatccatgaatttcgttatccacccgatgggtggggttgggaatgtaggtggctctgaaatcaatcccccatggatactgagggacgactgtattagtaaatttaattgttaaagaaaagcaaaaaaaaaaaatccagattattatgtgaaatgtccttgattttgaatgttggcttctagttcaaaaattttttataaccccaggaattcaaagaaacctgcctagaagccagatgcagcttgtcatttatcaatgtgtgccctttgccttggagactccttctccatagtggtctccaagctcagaattgggacttagacaccttggacaaggaggaagccctcctttcttgtaaacatctgctatgttacctttgctgtgttagaatttgtgtagaaggacccagagccctagttgttttgcctagaggctatgaacaggtgagtgatttccaggctgcattattcaaacattcccatgacactattattatttagtgatgtatttgtttgcttctcttccatgggagatggatgctgactatatatatattccatatattccaagtctccaattaagctgctgtgggatctgatatgtcttcctacctctttgatcttaggttcctcaaccgtaagatgaggggtttggactaggtaatcccacttgactattttaatctggaactctatggattgaatttcaatgtaacctattgtgcggctaccttctaggaggtcccaagtgtaggcaggttggaaattactttatgatatactaaaagtctggctgtctttcctatgtcacctctcgactcttaaactgagataacagatacaatttacttttatttacttttcggatttcagtactgtttttctccctagtggtgtaagcttcccatatgaagggaaaaaatggccctaaaatatccacaattcttagctttgagtgttataggtgaatgccttacctgataagagatcatgacagccagatgactgatgaatggagacaactgatgtctacatgaatctcactacatttttttttttgagacagttttgctctgttgcccaggctggagtttagcctggcgtgatctcggatcactgcaacctctgcctcctgggttcaagcgattctcatgtctcagccacccgagtagctgggattacaggcatgtgccaccttgcccagctaatttttctatttttagtagagatggggttccaccatgttggccaggctggtttcaaactcctgacttcaagtcatctgcctgcctggacctcccagagtgttgggattacagacgtgagtcactgcccctaacctcactttgtttagattcggaattgttcttattctactcagtttttaggattgacccatacctttgccatgggtatgtgaccataggaatactcacttgaaggcatttcacagaaacatttaatttgccccaactgcttgacttacaataggcttagttgctttaggaaataacgtggcatttctgtaagtgccctcattcctgcagtattgtaataggcctttcctcactacaattcattctccacacagtagccagaggattttcatctgtttgcttttgttttgttttgtttaaatataaataagattatataacatctgctacttaaaatcttccaaggacttcccatcacactctgaatgaaatccaaatagagtatcctaaaaggccctacaggatcttgcctcttattaattttatctcatgacatttcttatccttttgatcccaatttgaatgtcttctgcccagaaaaatcttccctaaacctatcttaagcagtgtccactctcaaatatctgtataagaaaaccctacttaatttcttgatagagttttcttttctttcttttaaaatttttaataatacatattttaacccagtgtatcacaaatactatcactttacaacctaatcagtacgaacaattatttttattttattctcatattttgtgggtacgtagtaggtttatatatttatgagttacatgagatattttgatacaggaatgcaatgtgtaatagtcaaatcagagtaaaggggtatatctgtcccctcaagcatggggcatcctttgtgttacaaacaagctaattatactcttttagttattttaaaatgtacaattaaatgattttttttttactataatgaagctgttgtgctatcaaatgttaggccttattcattctctctattttttgtacccattaaccatccccactgccccccgacccactgacatcccaccatccttccctgcctctggtaaccatccttttacctctatctatgtaagttcaattattttaatttttagctaccacaaataagtgacaacatgtgaagtttgtcattttgtgcctggcttatttcacttaacataatgacctccagttttatccatattgttgcaaatgataggatctcattctccatgtgtgacctttgccttggagactcctccttagtggtctccaagctcagaattgggacttagacaccttagacaaagaggaagccctcctttcttgtaaacatctgctatgttacatttgctgtgtgagaatttgtgtagaaggacccagagccctagttgttttgcccagaggctatgaacaggtgagtgataaatgtctttttagctcttttgcccatatgcaccacattttctttatccattcatctgttgatggacaccagttacttccaaattctggctattgtgaatactgctgcaataaacatgagagtgcagatatctcattgatatactgatttcctttcttttggatatataaccagcagtgggattactggatcttatgatagccctactttgttttctgagaaacctccaaattgttctctatagtgattgtactaatttatattcccaccaacagtatatgagggttcctttttttccacattctcaccagcatttgttattacctgtattttggataaaagccattttaactgaggtgagatgttatctcattgtagttttgatttacgtttctccgattatcagtgatgttgagcaccttttcatatgcctgtttatcttcttttgataaatgtcttttcagcttttttgcccatttttaaattggattattagatttttctcctatagagttttttgaactctttgtatgttctgattatgaatcccttgttgatgggtagtttgcaggtattttctcccattctgtgagttgtctcttcactttgttgattgtttcctttgctgtgcagaagatttttttaactttatggcaccccatttgtccatttttgcttttattgcctatgcttgtggggtattgctcaacaaatctttgcccagttcaatgtcctggagactttccccaatattttcttgtaatagtttcagatcttagacataagcctttaatccattttgatttgatgtttgtatatggtgagatatagggttctagtttattcttttacctgtgatatccagttttcccagcaccctttattgaagagacagtccattccccaatgtatgatctcagcacctgtgtctaaaatgagttcactataaatgcatagatttatctctgggttctctattctgttccactgatcagtgtgtctgttatatgccagcagcacactattttgattactatacctctgtagtataatgtaaagtcacataatgtgattccttcagttttattatttttgcttaagatagctttggttattctgggtttttgtggttccatgtaaattttggggttttttttctatttatgcagaggattgtcgttaatattttgatagagattgcattaatattgtagattgctttgagtagtacaaacattttaacaaaatgtattccaccaatccatgaacacggaatatctttcctttcgtttctgtcttcagtttctatcatcaatgttttatagtatatattgtagagatcatttattttcttgtttatgttaattcctaggtatttcattttatttggagccattgtaaatgagattatttcttgatttatttttcagaatgttcatctgttggcatgtagaaatgttttggattttgtatgtcagttttttatcctataactttactaattttttttaatcaattctaatagctctttttctggaggctttaggtttttccaaatataagattatgtcttctgcaaacaaggataatttgtctttttcctttccaatttggatgccctttaattcttttctcatctgactcctctaggtaggacttcctgtaccatgttgaataaaggtgaaattgggcctccttgtcatgttcccaatcttagaggaaagtatttcagtttttccccatttagtatgatacttatgggtcagtaattaatgacttttattatgttgaagtatgtttctcctacacccagtcttctgaggatttttattatgaaaagatgttgaattttatcaaatactttttcagcatcaattgaagtgaccaaatggtttttatctttcattctgttgatatgatgtatcacattaattgatttgcatatgctgaaccatccccacatctgtgggataaatcccatttggacatgatgaattatctttttaatgtgttgctagtattttgttgaggatttttgcatcaatattcatcagtgatattggcctatggttttcattttttgatgtgtctttgtctggttttggtatcagggtaatactggcctcatagaatgagtttggagtatttcttcctgttctatttttcaaaatagtttcagtagaattgatatgagctaatctttaaatatttgttagaattcgacagtgaagccatcaggtcctgggctttccttcctgggagacctgccccccgcccccgcacctcgcccccgaaaccaagtctcactctgttgcccaggctgtagtgcagtggcatgatctcagctcactgcaacctccaccttctgggagagttttaattatggcttttgtctcattacttgttggttagtctgttcaggttttggatttcttcctgattctgtgtttttccttgtccttaatattaccagtgagttgtgtaccttcagatgatttcttattgctcattaatgtccttttctttctgattgaagtactccctttagcatttcttgtaggatgagcatggtattgatgaaatccctcagcttttgttcatctgggaaagtctttatttctccttcatgtttgaaggatattttcaccagatatactattctagggcaaaagtttttttcccttcagcatcttaaatatgtcatgccactctctactggcctttaaggtttctactaaaaagtctcgtcaaagatattggaactccagtgtatgttatttctttcttttctcttgcttcttttaggatcctttctttatccttgacctttgggagtttaattattaaatgctttgaggtggtcttctttgggttaaatttgcttggtgttctataaccttcttgtacttggatattgatatctttccctaggttgggaagttctgtgttattatccctttgaatatttctacccctatctctttatctacttgctctttaaggccaataactcttagatttgcctttttgaggctattttctagatcctatagttgttgcttcattgttttttattcttttgtctcctctctatgcattttcaaataggctgtcttcaagctcactaattttttcttctgctttattctatttaattgtttcaatctcttagttaacttacgggattctgaattccttctctgtattatcttgaatttctttgagtctcctcaaaacatattttgaattctctttctgaatggtcacatatctctccaggattggtccctggtgccttatgtggttcatttggtttggtcatgttttcctggatcgtcttgatgcttgtagatattcattagcgtctgggcattgaagagttaggtatttattgtagtcttcacagtctgggttggtttgtatccatccttctcaggaagtctttccacatattcaaagggattgggtgttgtgatctaagccatctctgcattaggggacaccccaagcccagaagccctatggttcttgcagacttgtagaggttccactttgatgttcttgaataagatccagaagaattttctggattaccaagcagaaactcttgttcttttcttttactttatcccagacaaacagtctctctctctgttctgagccacctagacctgagagtgggttgacacaagcatccctgtggccaccaccactcggacgtgctaggtcaggccttaaactaatacagcactggatttcagccaagaaccgctgtaaccactacctggctattgccagtgttcactcaaggccctgggtctctacaatcacctgttggtgaagcaagccgtacttatgtcttttccttcagggcagtgagttctcctaggcccttggtaggtccagagatgccatctggaagccaggaactctagtcaaaacttagaagtccacctggtgatctattgtactgtggctgaattggcactcaaaccatgagacacagttcttcctagtcttcccttcactttccacagccagaggagcctcaccccttggctaccactaccataggcttacagggagtacttccaggctactgctgatgttcccataaggcccaaggcctctttattcagcttatcgtgaatgctgcttggcctgggactcacgcttgagggcagtgggctcccctctggccctgggcagatccagaaatgccatgcaagagcataatcctggaactggagaccccaatatcctgcttgtgctctatccttctgtggccaattggtatctaaggcacaagacaaagtcccctttacttttctttccacctttcctcagctggagtgtctccccatagccatcacagcttgggaatgtgctgagtctcatctgaagccagcaagtctcagagtctcatcctaggcccatggtgtactacctaagttttgctactggttattcggggaccaagggctctttagtcagtaggtgatgcgtcctgccagaactgggttcttctcttcaaggcaacagcttcccctgtggcccagggtgtgtctagaaatgtcatccatgagctaggtcctggaaaagaagcctcacgactctgaatgatgccctatcctactgtggctaagcttgtatccaagatgcaaaacaaagtcctttttactctgccctcacctctcctcaagtggaaggaaggggtctcttttgaagctgtgagctgtgcatcctagggttggggaaggggtggtgcaaccactgccttatctgatccagctgatatcttaatatatcatatgctccccgcaagtccactggctctgagcccagttcatcactaggactcacctaagacttgaagtccttgtggcctatactgcctttcaagttaattcaaggccccagagcactttatctcatagtggtgagtcttcccagaattcaagttctgacttctgggatgggcgattcccttctggctctgactggtttaaatattccctccatgggtgggagtcagcagagttcagcatagttttgctttctgctgtgacaaggcagcactgaatttaatgcagtgtctcacaagtgctgtactatccctgtctgaagcacacagattctctctccacaccatgtaggcactgcagaaggatgggtgaggggtggtgttggtgattcaagactctttcctatcctctttcagtgcttcttttaacaatatgaagttaaaaccaggtactgtgagtggtcatctgatttttcgttctttttttttattattatactttaagtttagggtacatgtttacaactttcattcttatgaaggtccttttttgtgtagatagttgtgaaattggtgttcttgttggggcatgattggtagaacattctatttggcccccttgctctgcccctcttctccatttatttttcaattgtataagtttaaagggtacaagtgcagttttgttacatggatatgatacatagtgatgaagtctgaacttttagtgtaactaaggaagttttttaaagtagggagaataacgatcatatgagaaggagcaagctatgtaaaaagcgtggcaaaagactattcttggctagtcagagtacaaaactagtgagatgggaataagcttgccttgttctaataactgatactagttcagcttagctaggacatattgagcgcagcagtgggtggagaaagcattgaggtgcaagagtggaaggggtaagatcagttaagaggctaatgaagcaatccaggcaaaaaatgatgacagctcaactagtatgttgccagtggagatggagagaaggaggtacattgatgattaagtggatgttggtgactctaaggtttctgttttgggtgactgggtgaatggaggtgccatttatagagctagagaatttgccaatagttacacaggtagtaaatgggtaaagccccataggattagacatttgtacctaacctaggtatacttttctctattgctagtattccacaggttccctgggactgaggcagcgacagaaatgcctgattcattgccctccaaagattgtgattcattgttaagggtcctagagagtgccgtctctgtctttggtagatattcttccagcagagagccataagactctttgcttatctgcaaagaccaggcatgcagtgcagcacttcatctcccctgagtttgcaatcatacaaagcaggaaacacagatataacagttcttgttaaacatactgtgttcatactgtcaagtcccagtatatttacaatggcatcacccattttcccaggctccaaatgtatcattgattcttaccattatctttttttttccccaagtcagagtctcactctgtttccaatgctggagtgcagtagcacaatctcgactcactgcagccttgctctcccaggctcaagcaattctcccaccttaacctctggagtagctgggactacaggcacatgccaccacacctggctaattttgtttatttttttgtagaaatgaggtctcactatgttgcccaggttggtctcgaacttctggactcaagtgatcctcccgcctcagcttcccaaagtggttgggattataggcatgagccattaatattctcttatgtcttgagttatttgtatttaaagttctattatttctttctaattttgaatagcctttttattcataatggctaagactatgtattgtgaaactagtgtcttgatttgacatctcaatcagctactcactgctgaaagttgcttcgcccctctttacctaaatttcccaatcttggaattttaatagtgtaaaatacttaaaatagtatccagcatatagtgaatactcaataaatgctaggttttattaatgtttttctttcaattccaatctcgctgtcacctccttaggttttgttcttatatttattattgattccttcatcaattcaatgaaaaattaatttgagctttatatgccagacaaatagattaccccagtaggctcctagtcattgtagtccaccttatacagcatgggtaaataattttaatgtacaactttgaccaagtcattcttgagttaaacagactaacttttagactaacttttagtctgttttattattgttttaaagttctctattgtcaatgcatccccattattgctcacacctaggacagactgctctcacacacacccccttgggtatatcattgccttttatgcttaagtccaaattctctttttaaaaataatcccaagtttttcatctgtcttttataataaggatcatctcataatactcttgtaaggatgttccatgctccaagacagctgaccctatatgtaccattcactgcactgccttgccaagaccttgccaccagctgcctgggttgctttcttcatctaaaacctgcccatacctccatatttgtgccttcacagtaacccagaggttattagctagccttggaacttatatcacacttacttatttttttgaaacagagtcttgctctgtcgcccaggctggagtgcagtggtgtgatctcagctcactgcaacctctgcctcccgggttcaagcaattctcatgcctcagcctcccaagtagcgggactacaggtgtgcaccatcacacccggctaatttttgtgtttttagtagagacggggtttcactatgttggccaggctggtctcgaactcctgacctcaagtgatccatgtgcctcagcctcccaaagtgctgggattacaggcatgagccaccgcacctgccatgtcacacttactatctttgtcacatagttaatatatgtgctttatattatgaattctttctctgcatatatactttgttctttaattcaaatgataagttgatggagattacaagttgtgttgtatgatgttcattggcacaaacaggagcttgttcaatgataatacaagggtaaatgcttttgaaataggaaaatgggcctcactgctgaattcctttacaataatttgtgtgttctagaaatgagctctgatcaccacagggtgtcactgccttacaagtcaaattttcctcaattggttgaggtgtatataggaattctcagaagacattcttgagagatcacaacaaaatgtatagatagcaatgcagccattgggagatgtggagatgctataaaatcacatagaacaaaaagtgaaaatttaatttacacactctaaacatcccctgaaatcctattcttcttccctctgttaacaatttgttgtatagccttccagatctttcctccttggagagagagagacagagaaggacaggcacaagatttagaaaacataaatgagatcctactctccgtgagcatgtgtgtgtgtggttgttcagtatcttttttaatttgataacatttcatttgccatcttttttgtctcattacatccagctttatctcattcttcttagcagctaatgcagctatttctgaatattgaaatgatcagtaattgatgtctttaatctttgaaatgtttgccttgatatagtccaaagctgtgattcagactggatttcattctgttgctcattatgtgaacactatacagttaattagcaaacacttgggagggttggtaggtggtgtgtagtaagttggaaaacagtttatgcaagccagattgccaccagaatttagaacagcataaaattaaatgccctaggtaatttacagggagtaaaggggaaaagaccgagagaaagagactgttagaataccaatgcatttttgtgtctgcattattgtttgtttctgattgtaaaataatacatgctcattgtagaagatgggaaacagaaaaatgtattaagaagaaagcaaacattaccctaatcctacaacccagacttatccacagttaatatttattgttgctcatatagcttatttcctttttcaaaatttttattatatgatacaacattatgattttaaagcatttaaaacagtacaaaagggtataaagtaaaaatgaaaagttctcttcccaccatccctggtcctcactttccacaaagtcattcactgttaacagtttctctcataatgtacatttaagtgtattgatattggctttattatgagtatacaaatgtatggtgtgtgatctatataccataatggggtcatactgcgttaatttttttatactactttttttccatttagctttctatcttgagcatacatatcctatatataattcaaatacaacccaaagattctgggcatggagctatttcaaaaagtttgacctgacactgccccccatgccattacatgcccttgagtttctaaccttacacaaaagacctgtagccttagctgagggccctttccaatgaatcacacattcatcctgtgtatatatggctctattttattttattttatttatttttttgagacaggtctcgctctctcctaggctggagtgcagtggcgcaatctcggctcactgcaagctccgcttcccgggttcacgccattctcctgcctcagcctcctgggtagctggaactacaggcgccctccacgacgcccagcttatttttttcatttttagtagagacggggtttcaccgtgttagccaggatgttctcaatatactgatctcatgatccgtccgcctctgcctctcaaagtgctgggattacaggcgtgagccaccgcaccggaccatatggctctattttagactgtttggtaggagatattagaggaacggatattataaagtgccaaagacctgagtttagatcccagttgtattggttgctagctatcttttaaaaataaaatgttttgaacaactttgtgatatatttttatcctttagagatgagaaaacagagaccaagccagggagaagtgattatataagatcacacagctagtttgtagtagagccggatcacacaaaggcctatttgaacaagaggctatgtgcttcccactctaacatcttggactttctttagaactcctgtaggtaacaatgtattgtattattgaaaatcaatgagagagtagatttcaagtgttcttaccacaaaaaaagataagtatataggtaatatgtatgttaattaactcgacttagccattccacaatgtatatacatctcaaaacatcatgttgtacatttatacagtgcttctcaatcaattaattaacttaaaagatttacaggcatatgccttcaaggttattgcctagccttttcactaaagccttgatacgagttatgtattctattatctttctagtatccgatcatcctctctctgattctcttttttttgtcacattccctttttaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatat

SEQ ID NO: 5695 - DNA, 51908 bp, human
cgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcggtaagtgactctgggactaatacccacccactcccacctctttcgtctagattctatccccctcccagtccccctgctccccccacacaccccacttggggtttcagcagtgggggcgggagcggaaggttaagaacactatgtggaatcaaatgaaactcaagggaaaatgactttgctaaagggctgggcaaagaaaggccaagaaggagaggagagagcttggtggaagaagtgaaagggggcaagaatggatggatttgtctagtctagtctcccctggctcggcactcccaatactccttaagcggtaaggattgtctttgacttaaccccacacagccaaagtcacaaccagagagaacaggattcacaaggccaaagctcccaggtaaccccctgaagccatagcgggtacctagagaagcttctgaaaagaaggaggaggggacagtggtttaaggtgcaaagttaggctattggaggcacagagtgaggcctggaagcagctgcgggggaggagctgctttgggcgtgccagctctttaaggaggggctgagcttggttggagaaggaagccagagcctaggctctgctccggccctttaagacgtggccaaggcagttggttcgtctgtgtaggtggaagactgactgggccgagttgctgtgattgctgaagtgaatccatttgtttagccacttggcggagctgtctttttgtgggcttttttttttaaccctaagaatttgggaaaaaataaatcacatccaaacaggtggccaaaggcaccatgtcttatttcttttggtattatattcatcgtgaagaaacgcatttattaagcacctgtcacccagtgtggtaataattgagcaaaaagaataatctttaaatttggatttgaaactgatggagattgccatggtttggggtaatctgctttgaaaccctagtatcaccacttattagctgcatcaccctgggccttgcttttctcttccatagaatgcagattaataattctatctcagtagatactcgggtggatgaaatatcttgtgtatgtggcagaggctgccacttgtatcttagttcaacttcccttttctactcagtttggaactatttttctggaccactgctgataaaattagtgtttttctgtccttaaaacaccttccagatgtggtaaaacgaaacttaggaagactgaattagtttgtccaaaggctgaggctagaacacaggttttatttgcttctgatttaacattgtttccaccagacttcatcacttctgaaagaaagggctactagcctgccttttctctcattctttgggcaacttaaccagaatgatataaccaacaggacttttggacaacagaaacaagtgataggtaaatgacctcatcccattcttcagagttatggggaagcccttgagagttgttgacctttggtgactgctggggacacagagaatgggtggggagcaatgtcttcaggtaagcctggagggcagacaggcagaaaacataggaagagtagaaataataacctcaaaagtaaaaatgacaggtgcatctatgtagtccaccctcaagaccaacttacttaatggctgtaccttcagagccctcaggagctatacatccctcttgtttagacttttcagggcacattggaaattgggaaaaaaataaccatgtagcagactaccatcaccactctcattgttctaatacatgcatttctgaggtggggttctcattggctaagtgaattccaataaccaaagtagcaaacagagcctagtcatttttgatcttgccagattgtctgtgcctggtgcggtgggggcagtatatgatcttctaagatctagctttacaatgccatgattttgtgaatgaaggaaaacttaattaggatgattgacatagatgatcatctagtatgattaccatcttattgttaagtagagtatgaataagggaataacattgtagtattgggctcatttgtttattcaaagacagtgtgagatcatgtttggtattcttcctgatttttttttttttttttgacacggtgtttcgcccttgttgcccaggctggagtgcaatggcgtgatctcggcttgccgcaaccttcgcctcccaggttcaagtgattctcctgcctcagcctcctgagtagctgggattacaggcatgcaccaccatacctggctaattttgtatttttagtggagacggggtttctccatgttggtcaggctggtctcgaactcccaacctcaggtgatccatccacctcagcctcccaaagtgctgggattacaggcatgagccacgtgcccaacctcttcctgatttttatatgctaatgtttactatcctcaactgagtttcatcatttagcctgtttcctcatctctaaaatgacatgataatttgtgattataaataatgtaaggaaagcattgaactcagtgcctgatatctaatatgtttcataagttgcggtctcatcatttttgttatttaaaaaaatttgttttatttaaatgctgctgtgtgtttgcagaagtggaatgtagattagtggacaggaagctggatttaaatatatgaaaggtgctagatgttctgtataatatactaaaagatgttatttgtgtatttagacaaaatagatgtgatgtgggcaaactaagctctaggattattaaggagcaataacctaactcaagagcccaatccagatatttcaaatcactagcaatttgacattttgttgtaacctcacactcaccatttctaatatacagcccatcatcacctctggactcttcactcattcctcattcaagactcttcctttcacttccctggttctgcaacttactatgaccatagtaatggtgaacttatttaaactctgtactttagttgtcatatctgtgcattggggataataatagacactacctcataaggttgctgtgaggaataagtgtgttaattttgtaaacacttagaaggcggcatgaaagtgaagcagtgggaaaatgtagctgttgtggtactcatgtccctttcccctcttcctcattttctcatttaattagatgccaatggctgttgtattttttcccctttgtatctggtatctgtttctttattattattctaactgccaccaccttaatttaggcgagacgtgcaaacaattagcctacagaccaactaaagctcacacgtgttttgttttccctaaaatttaaaaactttcaactaaaacatgcattttcaattggtaatgcattccgcctggctcaaaattcagtatttactaaagggtgcatggtgaaaaaagtctccctcctattcctgttctctagccacccattttgcctcgctggaggcaactaatgttatctatttattaggaatctctccagggatatttagtgtatatcaagcaatgagtatgtttgtgtgtgtgtgtgtgtgtgtgtgtgtgtgtgaataacattgtagtattgggctcatttgtttactcaaagataatgtgaaatcatgtttggttttctatagatagatagatggatatatatatatatatatatatggttcagtatcttctgattattcaaaagaaactggaattctaggaatttaagtgaaatctgattttgaaatactggttatcaatcaacttttaaaagtgtgggactaggcaacttgacatactgacatgaactgaattgtgacccccccatcccccccaaaaaaattcatacattgaagacctaatacctaagcttgtgactgtatttggagatagggcctttaggaaagaaattaaggttagatgagctcatattatatataatacatatataatattagtatatatgtaagtaccacaacaactatattttctcactgcttacttcactttcatgccttcttctaagtgtttacaaaattaacacacttattcttcactgcaaccttatgaggtagtttctattatatatatatgtgtgtgtgtgtgtgtgtttgtgtgtgtgtgtgtatatatatatccccttcaccttttatacacagatagtaacacattctgcatattgttctctacaacttgcttgtctacttaaaaatatactttggagatattttcatatatgcacattttttaaatgcctcattcttttttatgactgcataggtttttactatatgcatgagccacaaatttttaaacagttttctgttgattgatctttaagttatttccaaacttttgcagtgttatttgtaataacaataaaaacttttgtaagcagtgcattagagagctcaggctgccataacaaaataccattgactgagtggcttaaacaacagaaatgtattttctcacagttctggaggctgggagtccatgatcagggtgccaacatggtcagattttcatgaggactctctttctgacctgtagaaggccaccttttcactttgtactcatgtgatctttgtacaaatgggaggagaaagagtgaattctctctggtgtgtcttcttagaaagacactaatcctatcagatcagaacctcacctttatgagctcatttaaccttaatttctttcctaaaggccctatcttcaaatatagtcactaggttaggtcttctacctattaatttttttttggagagtggacacaacacaagtcagttcatagcagtgtgtcaaattgcctagtcccacacttttaaaagttggttgattgccaatatttcaaaatcagatttcccttaaaattctagaattctaggccgggcgcagtggctcatgcctgtaatcccaggactttgggaggccaaagcaggaggatcacctgtcagcagttcgaaaccagcttgaccaacatggtaaaaccccatctatattaaaaatacaaaattagccgggtgtggtggtgcatgcctgtaatcccagctactcaggaacctgagacaggagaatcgattggacctgggaggcggaggttgcagtgagccgagatcacaccattgcactccagcttgggcaacaagagtgaaactccgtctcaaaagaaaacaaaaattcttcaattccagtttcttttgactaatcagaagatactgaaccagcattctctcttggcaataattgcctagagttgatgagcctctccctccctcccctttaaaacagtacttgtattttttgttcaccacattactcatctggcctaggtggccttaacctgtctgacccctagtctagatattgagattatggcacctatgtaagctcttaccgcagtactcatagaatattccaatagcttctagttctactttgattctttctgccctctctactctgaggaccactgcaaggatatattccttaaaacacttttaaaaattatgttactctccttcactccacagtcatttactgggtgtctacaaagttggaagcatcatgctagaagctgaggtgatagtggtaaacttaccactttaggttaggtaaactatcagtttaggtgggacccttgccttcatggagtatgcagtttacttttcctctcgtctggatttcctttctgtttcttcttgactgtcgtagttcttcaaagcccacctcaaagcaaaccatttatttgaaattttctctgactattccattctcagtaatctcctcctctcccaattattgctcatagcctcaaatcataatccagcaatgcagcatctattatcttgtaatatttgattgctattattttatgcataattgtttctcatcacacggacctgggatctcaaacttaaatctccagggcccagtaaaatgagaaaagcatgccctgtctaaaggggacagctgttgatcatctccagctaatttttcccttgtgccaatgtacactctgtattataaaatctctcagcttttttagaaaagcaagaaataggatttttttcttaaaacatgaaatctgcatttgaaaggttgttagatgtttctgttttaatctttaacatcactatgagaaccaggccaacatctgcagtgggctgccagttttctctatctgacctagactgcaaatttactgaggatagaggccagagaccatgaagttttcttccttctggtattacctcctccctccttcccacataatatctactacagtgttgactatttagtagggtcttggtaaagacttgattatcatcagaaagttcccctttaagttaaccatgatgtcctgtaaatgacatagtagttctactttctccaaatacctaaatgtgcctttgaagacaattatcaggccagctttctttttccctgtccccctttttgccagatgtaatcatctacatttcttgatctagctccattttgttttcttttaaaaaaattggttatttctctagtttctttcatttttttctgcatttctcttctatttgccatttttcttgaaatattgtacatcacaaataaagtacagtatcttcagaaaggtctacatgatgctgagcatatatttaagtttgattatttggagctaattattccatctcttgtttcttcctatacgttcaatgatgcggttgtttcatcttcagttagaatgggcggggatgtgatgtgaatatatttatttcttgtttgttaaactagttctgataaatatacataacagttggtgctaaaagaataataacatacttattccttaattttgtagctagatcctagaatagatgtgtagcgttgaattggctactgcattaacctcactttctggagctctacaaactgaaatggtccaagactcttctaggatgccttgtcttggtgctcctgagccactgctcaggcagtgagtagaaaagttattcaagagccaaggtctcttcccttaagtacctgttgcacaaaacatggatgaggaccaattgtattgttacaaattatttgtggttgccacactaccaccatgtttaatttattggaggagattgttgcatgaaataaaggtatgaagtaatgaagaggatcacatgagatgttacataatgattcagagcaatgagtttttgctgctgtggctctttgtcccttagtgccatgctggagttgtaattcctagaggttttgttttataattaacataataattagtgggaatcttttaatactctgtacatatattcaatattagagtttgctgcaaagatataaaaacaccttcattattattattttcaactctaacaaactatttcaaagtacagggtagtagcaagtactttaaggaaaaaaaaagagctttggtatcaaacatcatacctggattccaatcccagctcaataatttaccagtttatgtgaccttgggattatttaatcccattgactctatttcttcatgtgtatagtgggatcaacagtaatacctacctcacagggcaattgtgaaaattaaatatgtcccattagaaatgccatgaagtgtggcacacgtttacctatgtaacaaacctgcacgtcctgcacatgtacctcaaactttaaaattaaaaaaagaaatgccatgaaatgatatatctgggatttgcataaaaatatacattgaggtagggggagtgggttgaggtacagatgaaacaaggtttaccattagctgaaaatcattgaatctgagagtaggcgcatggggtttttgtctacttttgtatgcatttaaaatcacccataatttttttttgagatggagcctcgctctttcatgcagagtggagtgcaatggcatgatctcagttcactgcaacttccacctcctgagttaaagtgactcgtgcctcagcctaccaagtggctgggactacaggcatgtgccaccacacctggctaatttttgtattttttagtagagatggcatttcaccatgttggtcaggctggtctcaaactcctgacttcaagtgatccacccgccttggcctcccaaagtgctaggactacaggcatgagccaccgcacccagtcattcatagtaattttttaaatgccattggaatgagactcaagtttacctgatggtttgtagaaaacttaatccttcttgacatcaatctcacaggttaagcagaaacctgagatgattattatggattttccatctatgtccttgtaataaaatcatatatcatagaatgttataaactggaagggatctgaaaaggactaagtagtttactcaaaatgacactgctagacaacagtgaagcctgatctagaatacaagtctcccagatcctagttaaatgattttcccattgtttcacatggccttctttaatagtaagagttttatctgcttattgcatataagattaattattgtctaaacataaatatatttgttcaatggagattcaaggcaaggggactggttctaggcatctgagattatgtttctataatacctttaaatctgttttgtcaattgattcttacaagtatcttgtgaggtgaatgaggagttatttccactttctacataaagtgacgagacttgctcaaggtcacacaacaatttactgattaaactagaactaaaatgcaggcctggagtttattgagcttcatctccacttgtatttccagttttagacttttatcataattcctcttagctttcatctttttccagaatgaggaatcttaatctctagcacattccaaggtaatttttcattctggcgtatttattttctttttgtggaaaagaaaatgtagcttaacatcagcgtctgagagaagcgcaactggctgaaagcactggaggctatgcaggtgatattgtagaacatgaactcataggagaatggagataaagatatcaaaaatcatacataagtttgttactggaaatggtttacatcttaagtatgtgaccgtatttatgtacttttaaaatttttctgacagaagtaatcctaaaaacttatatggctattttatctttacatcttataagatatttttacatgtgttatcatgattggtcttcctaacagccatgagtggggagggctacactggtgtattcccatttttcaaaggagaaaacagacatagaaaggtcaaatgacttgcccaaagttataaatcccttttctggtatttcttatcaccttatattttcaataccttatatgacttcactacttcaagtttagctggctgttgtagtaatcatgtaatactagatttcagtctttctgtcactgtcgttcatacatgttatgtgctgccagccttcatttatttttgtggcaatatgttttctcctcttaaattctgttctttttaacatcctagtttgcccccacttccttttctctcattccaggtaagctaagcaggaaaactacaggggttttctggtttgtttgttttttctttctgctggaaagatacacgtaaatttagaattagtcagctggactcagtttagatgatcccaattttgttggcaacatccaaagcattgtaatcaggagccagtcgaacgtatgccttcttctctccatcaggtcaaatcagggtgttgatttgccacatcagtatcatagagcttcttcacagcctgtttgatctggtgcttgttggctttaacatccacaatgaacacaagtgtgctgttgtctcctatcttcttcatggccgacacagtggtcagcggaaacttggtgatagcatagtagtcaagcttgtttctcctgggggcactcctccgaggatatttgggctgcctacagagtcgcagtgacttgggccgctggaaggtgaggggtgtgtggatcttcttttttgtgtgtgtggttgtggacacctttcaacactgtcttcttggccttcaaagcctttgctttggctttgactttaggaggggcaggagcttccttcttccctttccgcgccatcttatcggggttttctgttttacagctacttctgagtacctgctgtggtggtggttcttataatttagactgggtacctcaagtcactctccagcttttgtgtatgttgaaactcttgcttttttttttttttttttttttttttgagacggagtctcactctgtctcccagactagagtgcaatggtgcgacctcagctcactgcaacctccccatctcctgtgaagcgattctcttgcctcagcctcccaagtagctgggattgcaggcatgcaccaccactcccagctaatttttatattttcagtagagacagggtttcaccatgttggccaggatggtctcgatctcctgacctcatgatccacctgccacggcctccaaaagtgctaggataacaggcatgagccaccacgcccggcccaaaactcttgaatagaaaagtcatacagagctgcctgctgaggtgctacaactggaaggtgaggttgagttttccaatggtgacaggtgtgagcctgtttgggggaaatgagataaattggaggcttttgcaatctccctttattaagtagttggtttatagcaaccatttattctctgctatggaatctgcttaaaacagaagctggaagatcctactggtacccaggtaatttcattatagctgctttatgtctccagactactgaggtttaaatctcctctctgctgtttactaacttggtgatttggtggtaagcaacttcatctctctgtgccttagtttcctcatttttaaatttcattcaattcaatttaatttttattttctgtttttgaaacagggtctctctgcacccaggctagactgcggtggcacaatcatagctcactgtagcctctaccttctggtctcatgtgatcctcttgcctcagcctcacacaacaacatgcctggctaatttttaaatttttggtagagatggggtctcactatgttgcccaggctattctcaaactcctgagctcaagttatcctcccgccttggcctcccaaagtgctggaactacaagcatgagccactgtgccaggccctctttcttcctttttaaaatgaggaaataatggtgcctactactagggttgtaaggattaaatgaagatatctatagatagataaatagatataaacagaacagtgtctgacacaaagtaagcactcaatgaatgtcggctgttatagttctttttatcaccattccattattaatgtcatgctgcagagatatcctgaaggctttcccaaaggcccattgcaacactactcttaattcctctggaagatgtgcaataaaattgtctgaaaataaatgtgtactgtagtctttctcaaaacccttaagcattgatttttatttttaaatagttccagtacttcttataggttagaggccaaagatgaatgatatctgcttaagatcttcctaagtgattagttgtgttgtccttaaatgtgttcttcttttagcagacagtttttcagaaagaaggtgctcaccagatttgaggtattagaaaatggttggggagcactataatttgagtcagaggactaaagtttcagttctgattctagcacttctaaactatgtgatgtcaggcctccaaatttattatgtgtgaaatggaaattatatgaaagctgtgtatttccttactgtaaagctatgttgatgtatataagacattatttgaattgtccaaatgctgtatcctgtcaaagcacaaggtctttcttaggcccgggtcagggtttccagtgctctgctttctttttagttgtaggttctaatgactctgctttgcaccccttgtcactttatctctaggcatttttccctttcagggttggccaaaggatgggatgttttcttcttagccagcacctgctccagttccttggaggcactgttcacttttgtaagacaagctgatcattataggaaatgccacttttgtataatataaacttggggacatgacaaaagttacataattttatcaaactcctgtagtcacagtacctggaatgtggtttgtgatgtcctgcatatatgagacattgacccactggcgatgggactcaatcttcttccctatttcttcctcctctgtttccttctataggacccatgcccttaggagaaggaccagaaagtccagcttgtagacacaaaggcttgaagagccaatccaagcagaataatggttattacctcaagttggtaatttgcatttctggtgtcctcctgcctgagtgattcacatctcaatggcccaggccatatatactataacccccttttgtatatttccttaccacttccctgacagcttttgtgcagctgtctggtctctcttaggcacttagagcagaaattccaactctagagaagagcaagaggctcataaatccctcttcaaaaaaaaacagagccttctttaagaccttctgtgggccttaattttcttcagttttcaattttgcctgggtaaatattttttaaaattaaatttaaaaaaggaggttatataccttcccagtatctttccttatagtcattcctaccaatatttagaaggttgaccaggattacctaatggctattccatttggctgttttctgggtgagggcactagccagaaatggctgagacattattaattgtcagctctccctcttatactattttactaaaatatttgtgatataggagggccaagaagtatttttcaggctccttgattgttgctattaaagcttttgaagatgggcagttatagttctggatatggctctatctttcctcatttccctgatcattcattcctttattcactggacattagtacatagtgtataggagatgctctgctaaaagatagggatacaaaaaaaggaacaagactaggtaactattgaagggctcacctggtggtgaaggaaacggacagttcctctttgtgccaggtactgttgtaaatacttgaacatatatcaacttgatacatcctcatagtaattctgtgacctggtactataattattcccattttacagatgagaaaacagacacaggaggctggaaaaactttgcccaacttcttactgttaagaagtcacagaatcagaatgtgattctaggcactcactccagagcccacatgttttactacactttgagagcaatgtggagtattgaccagaaggggaaggaagtgactatgaaatgatgaagggctagatttaagagatatatctgcaggagaattattatagctgataaccaactggctgaagatagggagagaggagtcaaaggtggctgacccctaggtttttagactgatagactgggtttatggtggtgctagaaattaagattagaaatataagaggtggagcaggtttgtgaactcatggggtataaaagtcctatttgatacacaggacagattctttgggccagagttcaagattctgataatcaacaataataatggtggtgataatagctaactgagagtgttctatatgccaggatttgttttaagtgtatttacatgtacagttattcatcccttaatgaaggggatatgttctgcaaaatacatccttagacaatttttacattgtgtgaatatcatagaatgtactaacataaacctagatggtataatctactacaacctaggctatatggtatagcttattgctcctaggctacaaacttctatagcatgttactgtactggacactgtaggcagttgtagcataatggtgtatatttgtgtatctaaacatagaaaaggcacagttaaaatatggcataaaagattttaaaatggtgtacctgaacaccacttaacatgaaggaaacttgcagaactagaagttgctctgagtaagtcacttagtgagtagcgagtgaatgttaaggcctaggacattactgtaccttactttagactttttaaacagtgtacactaggctacactaaatttataaacaattttttcttataaattaaccttagcttactataacttttttagcttaaaacacaaatcctgtacagctgtacaaaaatattttatttctttgtattcttattttataagcttttttctattgttaattattttttttttgctttttacaagtttttgttaaaaactaagacacaaagacacatcagcctaggcctatgagggtcaggatcatcaatatcactgtcttctaccttatatcttgtcccactggaagatcttcaggggtaataacatgcatggagctgccgtctggtatgacaacaataccttcttctgggatacctcctgaaagacctgcctgagaatgttttataattaacttttttttagtaagtagaaggagtacactctaaaatgatgatagaatgtatagtgtagtaaatacagaaaacaataacatagtcatttgttatcattgttaagtattacatactgtatataattatattgactgacagcacagtcgatttgtttacaccagcatcaccacaaatacatgagtaatgctttgcactgtgacattacagcgggtatgatatcactaggtgataggaattttttagctctgttataattgtatagaatcattgtcgtatctatgagaacacttggacacaggaaggggaacatcacacactggggcctgtcatggggtggggggagagcggagggatagcattaggagatatacttaatgtaaatgacgagttaatgggtgcagcacaccaacatggcacatggatacatatgtaacaaacctgcacgttgtgcacgtgtaccctagaacttaaagtatgaaaaaaaaaagaacagtgtcgtatctgtgggtcatcgttgactgaaacgtcattacatggcatatgaatgtattaacatggaatgttcacattaactctgttaaggcaataccgtgttaccccctcttttggcaggtgaagaaactgaggttcatagaagctaatatagcctctcagaatcactctgcttcctcaactctgctgtctcttaatccataggaatcgaagaacagattggagttggctgtcttaagttgtacttgctagaaataatgaagcctgttgaaggtgttgtgtgaatgcagagggagaatcgaatcttctccactcctacgcatggttctggcagcaacaaagaaagctctcctggcgttttggtgcccccctgtgggctgtatgagagttacctgacctcacattctttttccaccatcacacctccttttcctgtcttagaaatcagaaaaagcttagctaccctctctaccacctctcacttcatagttaattacacctcaggcatctttcatgcataaattctctaattttctttcgttcttttccacccttttccaatttctgtacttgagaaaacacattccctcactctccttttctgtcactgtcatcaaaaaccttcgaaaatgtgattaaacacctaccatgtaccaggcaatgttctagggccttggaatacattagtgaaaaaaacaaagatgaaagtatctgcctgcaaggagctcagattctattggaagtcagttttcttaattctggcttctactattcttattacttactacagttcctccattaacctgttaaaagagaaactttagacaaattacacttaacagtttaatcgagcaaagaatgattcatgaatcaggcagcccccagaagaaataatagattcagagcaactctggggctgccatgtagtcagataatatttatggacagaaaatggaagtgaggtacagaaacagctggattggttatatctcagtatttgccttattcaaacactttgagttgttgactgcctgtaattggctgaaactctgtgattggcgcaacagtagattacactgtctacacatccagttaggttatggttcattatggatggggaaacctttaggctgaacttgaaatatgtaaggaggaagctttaagctaaccttaatttaacaaaccccacccccaagttccatggaagccttagggttctgcagaggatagtctgaaatcttttaatcatagatggacaagttgtggcttaggaaaaaaaaggccttgccaaagattatgggatgtgagtgctgcacatctaactcccagaaaatctggttgaggaagaaagctagtaggtgcttctagtatgaatgactgatggtttaaggcagctgaattaagacactaattcctttttttaagaggaaaaactaaagaagaaagagaaaactgtttttattaccccacctggcttgcagatttaagagacgtagacagataaaatacgtctctagagagatttggccttgatgtgtaaataagttcactcgggtaaatatatatataggagcttggaactccttcaagcaagaactagaccaggaaggtagaatactgaaaactgtagctatactgatgttcctctgaaggcagagcatgttggagaaataggaagaaacagattacctgcatgcagtttggtggaggggagcagctaatattattggggaaaagttaggtccatcttgatgagtaaaataaatcagaaggtttcaatgacttatcagtatctggtaagcactgaaagataaaggtcatagaacacacataacattaatggcatatttatgcatatagtgggttagattttattctgaaagttgtcttttccttttctcttttccagatatggataaactcataaacaacttggaggtccaacttaattcagaaggtggctcaatgcaggtattcaagcaggtcagttatcaggaaaatagggtgctaatattgggccataatagtattgaatacctggtagtgattacagaatttaaactcatttttctttctataacatgtttggggattgagaagaggtgaaggaagacatatttctagaaagtatatgaatgccttggtttcatagtcagctggggagtagatctggcctaaaagaaacatagcctctggaatcaaggctataaagacaagagtagacctttagtagacaatagcaactatttatatagcactatttcatatttcagataggatgaagattaaatgcattgtcttatttaatcttcaccataatcctgttgaacagtgtattaattagtattctccagagaaacagaaccaacaggatatgtgtgtatggtgtatgtgtgtgtgtatgcatatatgtacatggagagagagagagagagagatttcaagaaattggctcattagattgtggaggcatggcaagtccaaaaccccatcaggggtaggccggcaggctggagattcagaaggagttacagtttgagtccaaaagcagattgtgagaagaattctttcttgctctatggaggacagtctttgttttaaaaactaaggtcttcaactgattggttgaggaccactcacattatagagagtaatgtgccctatttaaagtacaatgttttaaatgttggtctcatccaaaaaaataccttcacagaaacatctagaataatgtttgaccaaatatctgggcactgtagcccagccaagttgtcacataaaattaaccatcattattcttagtttccccatttgatggaaaataaaactggccttgaacactccaagaattaggattcgaaacaggttatctggattttatgtcccagggctctgtgctagatgttgaagtcccgtctttcttggggttgcaaattcactgcatgagtgaaactcaaatacagtcaaaattaaccttgaaaatccttaaatcacctatagacttgagtatacagtgttgtatatacaatacttgtctgtttctttatttaattcatcagataaagttggttacatttaggaatctttttgttataatttcaacttttattttattttttgaatttttatatatttatttatttatttatttatttatttgagacggagtctcgctttgtcacccaggatggagtgcagtggcacaatcttggctcactgcatcctctgccttccaggttcaagctattcttctgcctcagcctcctgagtagctgggactacaggcacgcaccaccatgcccggctaatttttgtatttttagtagggacagggtttcaccatattggctaggctggtctcgaactcctgacctcatgatccgcccacctcggcctcccaaagtgctgggtttataggtgtgagccaccgtacctggccttatttttaatttttgtaggtacatagtaggcgtatatatttatgggatacattgagatgttttcatacaggcatgcaatgtgaaataatcacattatggagaatggggtatccatccctgcagcatttatcctttgtgttacaaacaatgcaattacactcttttagatattttttaagtgtacaattaagttattattgactctagtcaccctatcatgctatcaaatagtaggtcttatttgttatttccaacttttttttgtttttgagatggagtctctctctgttgcccaggctggagtacagtggtggcttctcagctcactgcaacctccgcctcccagattcaagcaattatcttgcctcagcctcctgagtagctaggactacaggcacatgccaccacgcccagctaattgtttgtatttttagtagagacagggtttcaccatgttggccaggctggtctcaaaatcctgacctcaggtgatctgcccatgtcggcctcccaaagtgctggggattacaggagagagccactgcacccagacaatttctaactattttttcgtacacattcaccatgaccacctcctcctcaacaccccactgcccttcccagcctctggtaaccatccttctactctctatgtccatgagttcaatggtttcgatttttagatcccacaaataaataagaacatgtgatatttgtctttctatacctgacttatttcactgaacataataatctccagttccacccatgttattgcaaatgacaggatctcattctttttatggctgaatagtactccattgtgtatctgtaacacattttctttatccattcatctgttgatgaatacttaggttgcttccaaatcttagctattgtgaatagtgctgcaacaaacatggaagtgcagatatctctttgatatactgatttcctttctttttggtatatacccagcagtgggattgctggatcatatagtagctcaattttcaatttttttgaggaacctccaaattgttctccatagtggctgtactaatttacattcccaccaacagtgcacaagtgttttcttttctccacatcctcaccagcatttattattgcctaactcttggataaaagccattttaaatatctcattgtagttttgatttacatttctctgatgatcactgatgttgagcaccttttcatatacctgtttgccatttgtatgtcttcttctgagaaatgtctattcaaatgttttacccatttttaaattgaattattagacttttttctattgagttgtttgagctcattatatattctggtgattaatctgttgtcagatgggtagtttacaaatattttctcccaatctatgggttgtctcttcactttgttgattgaatcctttgctttgcagaagctttttaattgatgtgatcccatttgttcctgtttgctttggttgcctgtgtttgtggggtattgctcaagaaatttttgcccagaccaatgtcctggagattttcccaaatattttctgcagcagtttcatagtttgaggtcttagatttaactctttaatccattttaatttaatttttgtatatggttagagatagggttctggtttcatttttctgcatatggatatccaggtttcccagcaccatttattgaagagaccacgcattccccaatgtatgttcctggcacctttgtaaaaaatgaattctttgtagatgtatggctttatttctgggttctctattttgttccattgcactgtatgtttgttttcatgccaatacaatgccattttggttactatagctctatagtataacttgaagtcaggtaatgtgattccttcagttttgttctttttgcttaggataacaggctattctcggtatttgtggtttgatataaattttcggatttcgtttttctatttttgtacataatgtctttttttctttttcttttttttttttttgagatgttgtctcactctgttgcccaggccggagtgcagtggcacaatcttggctcattgcaaccttcacctcctggcttccagcaattcttgtgcctcagcctcccaagtagcagggactatgggcatgtgccaccatgcccagctaatttttttttttttttttggcagagacggggtttcaccatgttaaccagactggtcctgaactcctaacctgaagtgatccacccacctctttgtgttcccaaagtgtgtcaacagtgaacaatctgacaaagcaacactttgcttcccaaagtgttgagattacagacatgagccactgcgcccagacaagaatgtcattggtattttgatagggattttattgaatctgtattgtgttttaggtagcattgaagcaggatatttccttgaccccttcgtgggtgggaactggagtgcactggtgctggacctagctggcgctttggcactagcaggggcgaattccactcacttaaacctgctgtgttctaccccttgtgggaggggaatcacaggtcagtgggtgcaggagctggggtgagtgcctttgggcaccggcaggagcaaaactctatgcgcaccccacagcagagtccggggggcggggtgcctgcgacccttgaagccccagaaggagtgttacagtacccttttagctttgctgtttgcagatggcttaagcattaacagctcaccagagggtcagtgtgacagccttctgcacccacactgaagttcttgtctggcatccaggaggaatgaggttacacaatgaatcaaaggtggttaatgtgggagattttattgctgatcaaagtggctatcagtgggagggggagctgaaaaggggatggagtgggaaggtaatcttcccctggattccagctgtccccatctggactcctctccaaagctatgccatcaagctgtccctctgaagtcaagccacttctctccaacatccaactataatctccaacgtttagctgcttctcctctttctgccagctgagcctgggtttttatgggcacaggatagggggcagggtcaaccatgggtggttttggaaaaggcaacattcaagcaggaaaacggaaatataagttctcactttggactgtggttccaggcttcagggtggggccctcaccagggacctgcccacttctgcctagaatttccctgcctcctgtccctgtcagtatggacatttcaacaatattgattcttccaatccatgaacatagaatatttttccattttttgatgtcctcttcaatttctttcttcagtgttttatagttttcattgtagacatctcccacttctttggttaatttgtaggtatttaattttatgtgtggctattgtaaacaggtttacttttttatttctttttcagattgttcactgttgacataaagatgctactgatttgattagtttgattttctatactgcagctttactgaatttgtttatgggttctaatagttttttgtggagtttttaggtttttccaaatataggatcatatcatctgcaaacaaaaataatttgacttctttttttccaatttgaatgccctttatatctttctcttttctgatggctctagccaggacttccaatactatgtggaataacagtgttgacaatgggcatccttgacatgtgccaggtcttagaggaaaggctttcagtttttccccattcgatatgatactagctgtgggtctgttttatatggcttttattatgctgaggtgttacttgtatccccagttttttgaagggatgttgaattttatcaaatgctttttcagcatcaattgaaataatcatggtctttaatccttcattctgttgatattatgtatcacattgattgatttgtgtgttgaactgtctttgcacccagggatcccacttggtcaggatgaaggatctttctaatatattgttgaatttggtttgccagtagcttgttgaggatttttgcatcagtattcatcagagatattggcctgtaattttctttttttgaagtgtctttgtctggttttggtatcagggtaatactggccttgtagaatgagtttggaaatagttcctcctctatttttcagaatagtttcagtagaattggtatgagctcttctttaaatgtttggtagaattcagctgtgaagccatcaggtcctgggcttttctttactaggagactttttattatggcttcaatctcattacttgttattggtctgttcatgttttggatttcatggttcaatcttggtaggttatatgtgtctaggaatttgtccatttttttctagatttttcaattcattgacatgtaattgctcatagtggctactaatgatcctttgaatttctgcaatatcagttgtaatgtctcctttttcatttctgatattatttatttggatcttctctctttttttctcattagcctggctaaaggtatgtcaattttgtttaacttttcaaaaaacaactttttgtttcactgatcttttgtattttatttcaaattcttttaattctcctctcatctttgttatttcttctactaattttggggttggtttgctcttgtttttctatttttttttccaaaagaatatgcaggtatcattgcttttctaggtctttaagatgaattattagattgtctgtttgaagttttttctgtcttctgatgtaggcacttacagctataaaacttccctcttatgactgtttttgctatattccataggttttgatatgttgttttccattatcacttgtttcaagaaatttttcaattttcttcttaatttcttcattgactcactggtcattcaggagcaatttttgttgtagttggtttttttgtttgtttgtgacagagtttcactgttgttgcccagtctggagtgaaatggtgtgatctcagctcactgcaacttctgtcccctgagttcaagtgattttcctgcctcaggctcccaaatagctgggattacaggcatgtgccaccacacctggctaattttgtatttttagtagagacggggtttctccatgttggtcaggctggtctcgaactcccaacctcaggtgatctgtctgcctcggcctcccaaagtgctgggattacaggcgtgagccaccttgcctggcaggagcatattttttaatttccctaattaagttaaagtttaataatattattaaacattaataaattaatgttttataatactactggtgtatggtgtttgtatagtttcctaaattcctcttgttattaatttctagttttattctattgtggtcagagaagatgcttgatgttatttcaggttttctgagtgtcttaaggtgtgttttgtcacctaacgtatagtctgtcactgagaatgatccttgtgctggggaaaacaatgtgtattcttcggccattggatgaaatgttctgtaaatatatattggatccatttggtctatagtgcagattaagtctgatgtttctttgttgagtgtcttcaacttttattttagattcaggggatacatgtgcaggtttgttacatgggtgtattgtgtgatgccgaggtttgggatatggatgatcttgtcaccatggtagtaagcatagtattcaatggtttttcaacccttgttctcctctctccctccttcttctagtagtacccagtgtctatttttgccatctttatgtccatgagtacccaacgtttagctctcataaataagaacatgcagtatttggtttcctgttcctgcattaattcccttaggagaatagcctctagctgtatccatattgctgcaaaagacatgattttgttcttatttatgtctacatagtattccatggtatatctttaccacattttcttgatccattccgccatcgatgggcgcttacgttgatttcatgtctttgctattgtgaataatgctgtgatgaacatataagtgcaggtatatttttggtagaatgatttattttcttttgtatatataccgagtaataggattgctgggtcaaatggtagttctgtattaagttccttgagaaatctaggagtcagttttaaaaattgttctcaatcattgtttggcccatggtgtataaatgaatttgcttaagttgcatatgcatatggatgagaatcctttgtactgttttaatgatatttagccctatttgatgtcccatttaccttaatcgtagcttttgcatttaggaattattagcacatcaaaacttgctaattgttggaaaacttctgcctgttgctagagcttactcatagttaataccaagaggaagctgagtataagtagtattagataaaaatctattgtacttgtaataaaaaatactctatgaaatgtcattgagcgtgcatagctacctttgttgttgttgttgttgttttgagatggagtcttgctctgtcacccaggcttgagtgcagtggtgtgatctcggttcaccgcaagctccgcctcctgcgttcacgccattctcctgcctcagcctcccaagtagctgggaccacaggcgcctgccaccacacctcgctaattttgttttgtactgttagtagagacagggtttcaccatgttagccaggatggtcttgatctcctgacctcgtgatctgccagcctcggcctcccaaagtgctgggattacaggcgtgagccaccgcacctggccaaagctaccttattttgagatctcagtgtacctaagtataattctagaaatgtttttctatgcattctttaggtatactgaacttccagaatttggaggcactttgaaattggttcaatgtgtagaaaagtctggatagtaagggatctaagcactttttttgtttgtttcttggcatttccaggatatcttatttttagaaaagcctgagtgcttgtgatacatggccacagcacactggccatgtctcaggtgacaaggaccaggagtttgtgttctataactacgcaatgctggcatcattctagtgtggagaagcctcctggtttgattcattataggatttgtttatttcaaaagttaggactagtgggtgggtgtgtagctcagggcacacatgctgctctcccttctctaaatttctgtatcaacataccatgcagtgaaagagcatttggttgtcacctgccctttatttttcgtttctgattacttcctacaagtgggatgtcttggtcaaaatgtatgagcagtgttagggttaaattttatcatacatgtctctcctttaccctaatttaatattgttaatatttggcacatattttcacacagcctaattctctctctctctctccccccattttattactattgtaagttgcatcaagaaactttacccctaaattattctgcatgcatcacctacaaataatgacattgtcctacataactacatcagcactgtcacgcccaagaaaatgaacaatatttccatgatactatctaactggctcatacctttcttttttttcctctctttttttaaagctgggctgctttctcagggttcatacatttctgtgccacttttccccacactgttttttctacatggattgtgcctcagtgagctagtatagctcaccaaactctttacttttcttagggttcaaattccaattctacctcttccatgaaacatacatagaaaaccccaactgtctcgaatctctagtgaaatcatgctcctggaacactaaattatctgtattagtcactaatgtggtacctgttctctattgtcaactgctttatgtaaatatctcttgtctccccagtaatattttttgtctcccaaacttcaattatttacttaccactttcacgatttttgccacatccttgccatcaatattatttacatactttaaaattatttaaataaataaataaataaatctatattagttttgtcctaagctatctggagaattctcggtttgatgtgaagtattactttcctagaattgctgaaacaaactaccacaaactaggtgggttaaaacaagagaaatgtgttctctcactgttctggaggccagaaatctgaaatcaagttattgtcagggtcatgctgcctctgaaggctttagtgaagaaacttttccttacctcttccagcttctggtacatataggtattctttggcttgtagccccatcaccccactgtcagcctgcatcttcacattaccttctcctctgtggctctgtgcgttattcctctgtatgtctcttataaggacactagtcattgaatttagggcccacccagataatccagcaggatctcttcaagatctttaattacatctgcaaagatactttttccaaaaagactctgggaattgaggtgtagacgagtgtttttgagggtcaccattcagcccactacaatgtgttatatatattttccaatgtacagtacaatagagtaagcataaatattaaaataaaataacttcatccatgtattacccaaaaacaaccttagattctttgagaaacaaaaactgatttagtatttttcacattttctatagttttgtgctaggtactaagcaaatacctagtgaacaaatatatgcatacatatacatatgtacatacatttgtacatttatgatctcattttgcctgattgtggctactaccatcccaatctcttaaaattgccgggtttgttagattaagtctaggtttctaataatacccatctccatccaccgctccattttctaatacccaaacagataatgctcttattggaaaaagaattgagttttagaaggttaaacagactttttgacctaaacatgaatgtgtacaatacatgtgtgcatatgtatccaggcataaaactaattggtttaacccagagcaaagctggaaggtacctgtttacaaaaacaggtttcctctttctgtttgggaggagcctaggctttatcgtgtttctataacatcccttcctctccttccacctactgtgctgtatatagtattttgttcttcatttctaatcttgcattaccactttcaagctccacatcagagctgtttcaaatacatgaaaaatggaaactttgtaacagttgattccactgattctcagggcctctctacctatcttaatcaaatgcttaaatatttgtgaaattaaccaacttttctcagagtttatttctagaattgagaggggtgtttcctaagaaccgaaagggtctcatctttagtaatatatgaataaataactctttttatatttttttgtccactcaaattggcttaaggaaacctgataaggattctgggtatttgaggagtagcactgtggaaattaaagcttgtcttcaaaccacccctaagtttctttgttttctttcatgcacaaccttcttcatagattcagaaatccggaaattcaggataaagtcttaaaatagcaaatggggaaagtagctattctctttgatagtgattgactagagaacacttaaaaactgaagccatcacaccacactaaaaatgaagaaagattactttaaaagaaaaatctgatgacagaacaatcctcagatgagtttcaaagctgaagtgattatattcaatgaagcatgaaataggtagccatcctgagtcatcttagtgaggattcttaaaatcaccaaaattctagggacaaaaactcactcaatcaagacttgaaggtcttcttcagaaccttcaagcataatatgctatctataaagataaggtaaagcaaatagggtgttggggttttttttaaccatagggagggttatattcaaactatggaataagttagactgtataacaatatttttattaaaattattttgatcatattgaaaaaagaatcctcagtgcacacaaacaaaacttattcaccctgatagtgtgtagatatggaatgcttgtctttaagccacaaaggaaggaacagtaaggtcaaccttgagacctacttttgagaacagtctgttttcttaagaaagcttgcattcagaagacaatatttacacccagaaaatacttgctacaagatagattcacttagacataagaggcatacttgggagtgatatgtacagaaaaaagtatgtgacactatgctttgaggaagttactattaagatactaaaacccaaacaactccccttccaacacttctctcaaagccttttgatggcaggagagaagtaatgattgaagccctgctgcagacagggtttggttaagaattggcaaaccacaaaataggtttagtctatgaaaggacaactaatgatggcctgttggagcaggaccctgtaacactgtatctcatcaaggcaataagaataggctatcagttcttcagtttcttgactttcatcaatcagtttccattttagatgttcctacgtaatgtttttcaataaaatgcatacctgcagatcaagtatcagctaaacacaaggccttgagctagtaacattgttgtaggcagcactcatctcactgaaatggcctttctttggcaaaagagagtaaaagttgccaaagtcgtgtttattttatagttaggattcaaagcttcagctttttcaggtttcttagtccaaaaagtccctaaaatttagctaaatcttttcttaatttcagtggcaagttgtgtttatttatacacctgcacccacaactatattcttacagaaaatgatattacagtgaattattattattattattattatttttgtgtgacagagtctcattctgttgcccaggctggagggcagtgacaatcctcctgcctcaacctccagagtaactgggactacaggtgcatgctaccatacctggctaatttttgcatttttagtagagatggggttttaccatgttggccaggctggtctcgaactcctgacctcaagtgatccacctgccttggcctcccaaagtgctgggattacaggcatgagccaccgcgcccgccctacactgaacctcttcttatgctttctattgtaactctatttctcactgttattgacagcaatgatagactatggaaagagataacattttttcttttgaagattccttggattctatctttttaatctgggaatggagctactcaagtgaagagttatgtgggaaatgtaggaaaaataagagcttaagttgatttgggggattctgagaacaggggagttttatgttcagcagagccaatcttgacaacttcctctccctgtcaacaggattctactccccccttatctggatgggtcaaatccacccatgagggatgggttacatttgcagtatgtgaaacagtgggacaaatcacagaaatcatgtcctggaggagcagattgaagcaatgtttggaccacaaacaagggctgagttgggataggtgctggcaaatcaagaaaccaagagtgttgtagcataaaagaagggaaaagaagatggcagtctggccaaattctggagacaaagcacggatgggtttttggtgccgttactcattcccagcctgctctgagcattgttgtcatgtgtttttgacgcagagtcttgctctgtcacccagactggagtgcagtggtgtgattatagatcactgcagcgctctgagggtttttaaaataaagtcagagcaagaagacactgcctcccctgccacttattgctctctgaattcagacccttattatctctcacctaaattttaaaaaatcataagcataacataattatcacaccttaaaattaactaattcattaatattgtccaatatccagtcaatactcaaatatttttacatgtctcatcgagatttttccacttgctttcttttgaatgtctttgaatctagttttattcctctttcaatcaatcttcattaagaagctagttaaatctcacagaaatagttcttcccttgttactcctctcttccaaacaattatcttctatcacccaacctttcattgaactctacctttcctcatcttccaaatatacaaaactaaaagtggttatgttttatataaaggatgtattccttaacatttttcataatttaaaactcccataattcaagtatcatgctgatagataatggaagcttgtttgtttactggctaaagaggtggtaccaccatctccaaaatcatcttcaagatccagagtgttgcttggcagtggcatacacagttcattatatccttgacctttgaattcatggaattcttagaaagtttttaattaggttgaggctttatttcatatattacatataaatgatcatttattagttttttaaaaaaagtattagttttttattaaaaactattagttttttaaactaataaatgtatttattagttttttaaactaatgtatttattggttttttaaactaataaatgtatttattggttttttaaactaataaatgtatttattggttttttaaactaataaattggttttttaaactaataaatttatttattagtttaaatcatttatgatcatttagatcatttattagttttttttaaaaatcccagaattaaaaagttgcagagttcaattttgcatataatacaactaactgtattgcaagtttatttcatagtttattctataattatactgtctgttgttatggctctatagacaggaatatctttcttatctcttatctgcctagaaaatttctattaattttctatgactcagctgaaatatcacctcctccttgaagccttccctttctagtcagaatgagtcattcccttttgtttttctaaaacgccttgcttgtatgcctgttacattatttattatggtatgatttataaactattcacattattctatcattatatttaatatgttggtatgtacttattggctgtactttattgatgtgtgctgccactgagcttatagtagatgctcagaaagtgttgactttaaataattttgcaagattattgtgaacgttaaatgaaataatttttaacaattgccggatacagtacctggtacttacagatagtaaagtttcccgtctgtttttctctttagtttactcctgccttatttctcccagcaccatgtattccttccatgtgaaatgaatagagatttcttttttacattgcttgcatgtctcttcagggtactaacactgacttatgcatctctcatttgtttatttatttaaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcaggtaagtaacaatattgcctctttcctggccttcctgaatctattcccttttagagtcatcctatctcctgtctcttttcacttcctccaattattcttgcacactgcttcaagagtaatctttcaaaagtactgttttttatgtctttttaatgcttaagaatgtacaatgagtcttgattagaccatgcttctcaaacaagtacaagtatgcatatctatcagtgacatatcaaacaacttcctggaacttccacattatttgatattaaataatttaagcattttatatttaaaatatgattatcttgtattacaaaatgcaaaatttaaaaacctgttaagataaaccacatgcttcaaaaatagttgaagcttactaaaggcatccaccctcggacttttcaggagaatgtgtttattttatgccattcagaatgctttggtgggaaagttgagaacaatatttctatctcaaacatacttagccagtattagctcctgcctctaccaatactttcccttttctcttccctacaaaagaagtaattgaaatattgtcatcttccctgtgttcttcctcatttggcatctatcactttccattttacttatttatttgcctgtatcacaagagtttgggcattattcacaactgaattgtaaattcctgaaaaataatactctatcttaatttttttatgtatgcctccagagaacttaacacagtgctaggagttgtcttgcaacagataatttgatgaacaaacaaacttgaaaatttgtccaagagagaattcaaatgctataatcttccattttattttatttttaaaataagttcagaattcagaaaggtataaattaagtctctcttccaccactatcccccaaccactagttttcctcccagaggtatatctgttttagtttgtaatcaggaatgatcaaggaaaattatgtggcctctaaagcaggctgataatgttttgcataaatcggaaaggccaaggggtggaaatgactaggaagcagatttcagcttactgtaaaagagtatctacccttgaaatttgatgccctgtactaaatgtaggaggctgaaaaacaacatactactaagcatcaagttgctgagactctgcactggtcttctgaatacaaatattattattgactagtggttaattgtggtaatgataagtgttcataatcttattttgagatgtgatatccattccatatatgaagggagagccaaacaaacaaaccaaaaaaaggaaacaaacaaaaaaggaaataaaattcctcgtgtgacagtttatgctgagataaaggcagtggtaacatcaaaggatggtttgaaggagctttgaatagtccccataatatcatcagtccatcagagccactctaaataaacaggataaattttaaatgtgctcaatgtggttccaagctaagggcattggcccaatggtgtctgtattagttcgttttcatgctgctgataaagacatactcgagactgggaagaaaaagaggtttaattggacttacagttccacatagctggggaggcctcagaatcatggtgggaggcaaaaggcacttcttacatggtggcagcaagagaaaaggaagaaagaatagcggaaagccctgataaacccatcagatctcatgagacttattcactatcatgagaatagcaggggaaaactggccaccatgattcaattaactcctcctgggtccctcccacaacatgtggaaattctgagagatacaattcaagttgagatttgggtgggggcacagccaaaccacatcagtatccaaaatggggggcttactaaaccttagggggcacatataaaacaattggagtgcaagaagaaagtatcaaaatttgtattttcttacccttaaaaattgacaggtaatattgtatgttttaatcatctatagcatgatgttttgaagtacatatgcattgtggaatggttaaatctagctaaataataaatgcattacctcattatcatttttgtggtgagagcacttaatgtccattctctttacaattttaataaataaaatgtatcatcattaactatacttgccttgctatacaatagatctcttgaaatgtattcctcctatctagctataattacgtatcctttgaccaatatctccccatccccctccccactagccaccccagcctctggtaactaccattctactctacttgcatgagattaacttttttagattccacatatgagtgagatcatgcactatttgtccttctgtgcctggcatatttcacttaacataatgtcctccaggttcatctatgctctcacaaatggcaggattttattctttgttataactgaataatattatattgtatatatatatatgtcacatttcatttattcattcatttgttgatagatattttaggttggttccacatcttggctgttgtgaataatgctgcactaaacagggatgcagttatcttttgggcatgtgattttatttcctttggatatatacccagaagggagattgccagatcatacggtagttctaattttaagtttttgaggaacctccatactattttccataaaggctataactagtttacattcccatcaacagtgtgtaagtgttcccttttctccacatactcaccagcacttactgtcttttgtcttttcgataatagtcactctaacttaagtgagatgacatactactttttgtttgttttcttataatgtatacaaaattgtaggataccgatacatgtatatcacatacatgcacaaacatgcacacctcaagatacatgcttaaaactttttagtgaatgatatgcaaagtatagagacaactcttttaaccaaatacttgttccccaccttatcaccacccccaagtttcttctctatagaaattttgaaggtttcactggatctaggagactgttgaccacctgattgagtttttaggaattagaaacatcaggggttgataataaggaatatttgacagcttctcccaacataggtggaaaggaaggttgtatcaagcacctactaggtggtaggtatacgtttcatctcattgacttatttctgtttaggagcacaaaggccaaggtggatgttctcacatctggactaatcctagaatttgattttaggacagccaggagctattcagtgagttcaattcaacacacacacacacacacacacgttgaaactaacttttcagctgaccctgtcctggtagctggagatagaaagatgaatcatacccagaccacatcctagagacactctcatttgataccactcatagtggtatcagaactcttcatactactcttactttaaaggcatttctgttccctgctatgcaaaaaaaaaaaataaaatgttattctcttccttccatgcaaatacacttctttcatcttgttttttatttctttatttttctgtcttgctgccacttcttaaggtgggacaaactgggaatcctgaaaatgattaaagaggcacatacatcttcagctcacactgctccctttctttgcttttagtgaaagttgaccccacctccatgtctccactggaaattccaagtgacagtgaggagagtacaattgagagtggatcctcagccttgcagagtctgcagggactacagcaagagtgagtactttttgtcttcaagtctgtctttgtgtatgtgtgtgtgtgtgtgtgtgtgtacatttgcacatatgtataggtggaactaatgatcagacacaagagtaagaatttgaggacaagaaatatagggagactgcctttccagtgaaagtatatgagtttgtgtgcacacatgtgcatgtacatgcatgctatagtagagctatgttctaactgtagatcatcaatttttcttttgaaaaatcttcaaatttcccataaagtgtagttatgtactgtttctctctgtaagtttaaaacagctttgtctttcaatattgaaactaattggaagtagttggcttgtgtttagcaacaactgttgtatgaaaaacaaatttctttaagcaggaaaatgaaacttattgaagtgaaatgctcacactgtttgggaacacaaccactgaaggaaacactaccacctcccatgctttctctgagcacctactgagggacctgtacctactgagcagaatggcctagttgacagaattgtttttactattccaattatttctttttggggggacctagcattaaattcacgtaaattaaaagccgatatgatgtggcaccaatgaatgtaaattcatttttttagccttcactttaaagtcactgtttggctttatctctatttctttgatcagaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggtctgcccactcccatctcacccccaacacacacacacacacacacacacacacacacacgagagagagagagagagaggggcagagagagagagagagaggggcagagagagagagagaaaatttctgagagacagagaatgaagtcctgaaacaaagactgatgcatttatactcatgggcacaggctccattcatggtttttatccctatttcttgtccctactctaaggcagattttataaaactggcctaggaaaacactaaactaaatctggtgtcttaatagtcatcattcccagtgagccctgtgggtctttctaattgcggagtcaacacttaagcaaagattaaggcattactcccttccttactaccagggtctcacaagttttactaagcatggaaaagcacaagaacaatttaaactatgtgaaattaaagcaggttgtaatccactaaccattaacgtgtctttgttcacattaaaaaaaaaaggtgcacataaataaataaagcagacctggtagtgatcctgtcaaaccgaacagcacatacctgatctgaagaaggagagctgccactcaaatccatgtagtcagccatcaatattcttaggttccacatccgtggattcaaccaaccacaaatcaaaaatattttttaaacaacaaaaataacaatacaacaataaaaaaatacaaattttaaaatacagtataacaactacttacatagcatttacatggtattaggtaacgtaagtacatctagagatgacttaaaatataggagagaatgtgtatagattatatgcaaatgctatgttattttatatcagggacttaagcatccatgaatttcgttatccacccgatgggtggggttgggaatgtaggtggctctgaaatcaatcccccatggatactgagggacgactgtattagtaaatttaattgttaaagaaaagcaaaaaaaaaaaatccagattattatgtgaaatgtccttgattttgaatgttggcttctagttcaaaaattttttataaccccaggaattcaaagaaacctgcctagaagccagatgcagcttgtcatttatcaatgtgtgccctttgccttggagactccttctccatagtggtctccaagctcagaattgggacttagacaccttggacaaggaggaagccctcctttcttgtaaacatctgctatgttacctttgctgtgttagaatttgtgtagaaggacccagagccctagttgttttgcctagaggctatgaacaggtgagtgatttccaggctgcattattcaaacattcccatgacactattattatttagtgatgtatttgtttgcttctcttccatgggagatggatgctgactatatatatattccatatattccaagtctccaattaagctgctgtgggatctgatatgtcttcctacctctttgatcttaggttcctcaaccgtaagatgaggggtttggactaggtaatcccacttgactattttaatctggaactctatggattgaatttcaatgtaacctattgtgcggctaccttctaggaggtcccaagtgtaggcaggttggaaattactttatgatatactaaaagtctggctgtctttcctatgtcacctctcgactcttaaactgagataacagatacaatttacttttatttacttttcggatttcagtactgtttttctccctagtggtgtaagcttcccatatgaagggaaaaaatggccctaaaatatccacaattcttagctttgagtgttataggtgaatgccttacctgataagagatcatgacagccagatgactgatgaatggagacaactgatgtctacatgaatctcactacatttttttttttgagacagttttgctctgttgcccaggctggagtttagcctggcgtgatctcggatcactgcaacctctgcctcctgggttcaagcgattctcatgtctcagccacccgagtagctgggattacaggcatgtgccaccttgcccagctaatttttctatttttagtagagatggggttccaccatgttggccaggctggtttcaaactcctgacttcaagtcatctgcctgcctggacctcccagagtgttgggattacagacgtgagtcactgcccctaacctcactttgtttagattcggaattgttcttattctactcagtttttaggattgacccatacctttgccatgggtatgtgaccataggaatactcacttgaaggcatttcacagaaacatttaatttgccccaactgcttgacttacaataggcttagttgctttaggaaataacgtggcatttctgtaagtgccctcattcctgcagtattgtaataggcctttcctcactacaattcattctccacacagtagccagaggattttcatctgtttgcttttgttttgttttgtttaaatataaataagattatataacatctgctacttaaaatcttccaaggacttcccatcacactctgaatgaaatccaaatagagtatcctaaaaggccctacaggatcttgcctcttattaattttatctcatgacatttcttatccttttgatcccaatttgaatgtcttctgcccagaaaaatcttccctaaacctatcttaagcagtgtccactctcaaatatctgtataagaaaaccctacttaatttcttgatagagttttcttttctttcttttaaaatttttaataatacatattttaacccagtgtatcacaaatactatcactttacaacctaatcagtacgaacaattatttttattttattctcatattttgtgggtacgtagtaggtttatatatttatgagttacatgagatattttgatacaggaatgcaatgtgtaatagtcaaatcagagtaaaggggtatatctgtcccctcaagcatggggcatcctttgtgttacaaacaagctaattatactcttttagttattttaaaatgtacaattaaatgattttttttttactataatgaagctgttgtgctatcaaatgttaggccttattcattctctctattttttgtacccattaaccatccccactgccccccgacccactgacatcccaccatccttccctgcctctggtaaccatccttttacctctatctatgtaagttcaattattttaatttttagctaccacaaataagtgacaacatgtgaagtttgtcattttgtgcctggcttatttcacttaacataatgacctccagttttatccatattgttgcaaatgataggatctcattctccatgtgtgacctttgccttggagactcctccttagtggtctccaagctcagaattgggacttagacaccttagacaaagaggaagccctcctttcttgtaaacatctgctatgttacatttgctgtgtgagaatttgtgtagaaggacccagagccctagttgttttgcccagaggctatgaacaggtgagtgataaatgtctttttagctcttttgcccatatgcaccacattttctttatccattcatctgttgatggacaccagttacttccaaattctggctattgtgaatactgctgcaataaacatgagagtgcagatatctcattgatatactgatttcctttcttttggatatataaccagcagtgggattactggatcttatgatagccctactttgttttctgagaaacctccaaattgttctctatagtgattgtactaatttatattcccaccaacagtatatgagggttcctttttttccacattctcaccagcatttgttattacctgtattttggataaaagccattttaactgaggtgagatgttatctcattgtagttttgatttacgtttctccgattatcagtgatgttgagcaccttttcatatgcctgtttatcttcttttgataaatgtcttttcagcttttttgcccatttttaaattggattattagatttttctcctatagagttttttgaactctttgtatgttctgattatgaatcccttgttgatgggtagtttgcaggtattttctcccattctgtgagttgtctcttcactttgttgattgtttcctttgctgtgcagaagatttttttaactttatggcaccccatttgtccatttttgcttttattgcctatgcttgtggggtattgctcaacaaatctttgcccagttcaatgtcctggagactttccccaatattttcttgtaatagtttcagatcttagacataagcctttaatccattttgatttgatgtttgtatatggtgagatatagggttctagtttattcttttacctgtgatatccagttttcccagcaccctttattgaagagacagtccattccccaatgtatgatctcagcacctgtgtctaaaatgagttcactataaatgcatagatttatctctgggttctctattctgttccactgatcagtgtgtctgttatatgccagcagcacactattttgattactatacctctgtagtataatgtaaagtcacataatgtgattccttcagttttattatttttgcttaagatagctttggttattctgggtttttgtggttccatgtaaattttggggttttttttctatttatgcagaggattgtcgttaatattttgatagagattgcattaatattgtagattgctttgagtagtacaaacattttaacaaaatgtattccaccaatccatgaacacggaatatctttcctttcgtttctgtcttcagtttctatcatcaatgttttatagtatatattgtagagatcatttattttcttgtttatgttaattcctaggtatttcattttatttggagccattgtaaatgagattatttcttgatttatttttcagaatgttcatctgttggcatgtagaaatgttttggattttgtatgtcagttttttatcctataactttactaattttttttaatcaattctaatagctctttttctggaggctttaggtttttccaaatataagattatgtcttctgcaaacaaggataatttgtctttttcctttccaatttggatgccctttaattcttttctcatctgactcctctaggtaggacttcctgtaccatgttgaataaaggtgaaattgggcctccttgtcatgttcccaatcttagaggaaagtatttcagtttttccccatttagtatgatacttatgggtcagtaattaatgacttttattatgttgaagtatgtttctcctacacccagtcttctgaggatttttattatgaaaagatgttgaattttatcaaatactttttcagcatcaattgaagtgaccaaatggtttttatctttcattctgttgatatgatgtatcacattaattgatttgcatatgctgaaccatccccacatctgtgggataaatcccatttggacatgatgaattatctttttaatgtgttgctagtattttgttgaggatttttgcatcaatattcatcagtgatattggcctatggttttcattttttgatgtgtctttgtctggttttggtatcagggtaatactggcctcatagaatgagtttggagtatttcttcctgttctatttttcaaaatagtttcagtagaattgatatgagctaatctttaaatatttgttagaattcgacagtgaagccatcaggtcctgggctttccttcctgggagacctgccccccgcccccgcacctcgcccccgaaaccaagtctcactctgttgcccaggctgtagtgcagtggcatgatctcagctcactgcaacctccaccttctgggagagttttaattatggcttttgtctcattacttgttggttagtctgttcaggttttggatttcttcctgattctgtgtttttccttgtccttaatattaccagtgagttgtgtaccttcagatgatttcttattgctcattaatgtccttttctttctgattgaagtactccctttagcatttcttgtaggatgagcatggtattgatgaaatccctcagcttttgttcatctgggaaagtctttatttctccttcatgtttgaaggatattttcaccagatatactattctagggcaaaagtttttttcccttcagcatcttaaatatgtcatgccactctctactggcctttaaggtttctactaaaaagtctcgtcaaagatattggaactccagtgtatgttatttctttcttttctcttgcttcttttaggatcctttctttatccttgacctttgggagtttaattattaaatgctttgaggtggtcttctttgggttaaatttgcttggtgttctataaccttcttgtacttggatattgatatctttccctaggttgggaagttctgtgttattatccctttgaatatttctacccctatctctttatctacttgctctttaaggccaataactcttagatttgcctttttgaggctattttctagatcctatagttgttgcttcattgttttttattcttttgtctcctctctatgcattttcaaataggctgtcttcaagctcactaattttttcttctgctttattctatttaattgtttcaatctcttagttaacttacgggattctgaattccttctctgtattatcttgaatttctttgagtctcctcaaaacatattttgaattctctttctgaatggtcacatatctctccaggattggtccctggtgccttatgtggttcatttggtttggtcatgttttcctggatcgtcttgatgcttgtagatattcattagcgtctgggcattgaagagttaggtatttattgtagtcttcacagtctgggttggtttgtatccatccttctcaggaagtctttccacatattcaaagggattgggtgttgtgatctaagccatctctgcattaggggacaccccaagcccagaagccctatggttcttgcagacttgtagaggttccactttgatgttcttgaataagatccagaagaattttctggattaccaagcagaaactcttgttcttttcttttactttatcccagacaaacagtctctctctctgttctgagccacctagacctgagagtgggttgacacaagcatccctgtggccaccaccactcggacgtgctaggtcaggccttaaactaatacagcactggatttcagccaagaaccgctgtaaccactacctggctattgccagtgttcactcaaggccctgggtctctacaatcacctgttggtgaagcaagccgtacttatgtcttttccttcagggcagtgagttctcctaggcccttggtaggtccagagatgccatctggaagccaggaactctagtcaaaacttagaagtccacctggtgatctattgtactgtggctgaattggcactcaaaccatgagacacagttcttcctagtcttcccttcactttccacagccagaggagcctcaccccttggctaccactaccataggcttacagggagtacttccaggctactgctgatgttcccataaggcccaaggcctctttattcagcttatcgtgaatgctgcttggcctgggactcacgcttgagggcagtgggctcccctctggccctgggcagatccagaaatgccatgcaagagcataatcctggaactggagaccccaatatcctgcttgtgctctatccttctgtggccaattggtatctaaggcacaagacaaagtcccctttacttttctttccacctttcctcagctggagtgtctccccatagccatcacagcttgggaatgtgctgagtctcatctgaagccagcaagtctcagagtctcatcctaggcccatggtgtactacctaagttttgctactggttattcggggaccaagggctctttagtcagtaggtgatgcgtcctgccagaactgggttcttctcttcaaggcaacagcttcccctgtggcccagggtgtgtctagaaatgtcatccatgagctaggtcctggaaaagaagcctcacgactctgaatgatgccctatcctactgtggctaagcttgtatccaagatgcaaaacaaagtcctttttactctgccctcacctctcctcaagtggaaggaaggggtctcttttgaagctgtgagctgtgcatcctagggttggggaaggggtggtgcaaccactgccttatctgatccagctgatatcttaatatatcatatgctccccgcaagtccactggctctgagcccagttcatcactaggactcacctaagacttgaagtccttgtggcctatactgcctttcaagttaattcaaggccccagagcactttatctcatagtggtgagtcttcccagaattcaagttctgacttctgggatgggcgattcccttctggctctgactggtttaaatattccctccatgggtgggagtcagcagagttcagcatagttttgctttctgctgtgacaaggcagcactgaatttaatgcagtgtctcacaagtgctgtactatccctgtctgaagcacacagattctctctccacaccatgtaggcactgcagaaggatgggtgaggggtggtgttggtgattcaagactctttcctatcctctttcagtgcttcttttaacaatatgaagttaaaaccaggtactgtgagtggtcatctgatttttcgttctttttttttattattatactttaagtttagggtacatgtttacaactttcattcttatgaaggtccttttttgtgtagatagttgtgaaattggtgttcttgttggggcatgattggtagaacattctatttggcccccttgctctgcccctcttctccatttatttttcaattgtataagtttaaagggtacaagtgcagttttgttacatggatatgatacatagtgatgaagtctgaacttttagtgtaactaaggaagttttttaaagtagggagaataacgatcatatgagaaggagcaagctatgtaaaaagcgtggcaaaagactattcttggctagtcagagtacaaaactagtgagatgggaataagcttgccttgttctaataactgatactagttcagcttagctaggacatattgagcgcagcagtgggtggagaaagcattgaggtgcaagagtggaaggggtaagatcagttaagaggctaatgaagcaatccaggcaaaaaatgatgacagctcaactagtatgttgccagtggagatggagagaaggaggtacattgatgattaagtggatgttggtgactctaaggtttctgttttgggtgactgggtgaatggaggtgccatttatagagctagagaatttgccaatagttacacaggtagtaaatgggtaaagccccataggattagacatttgtacctaacctaggtatacttttctctattgctagtattccacaggttccctgggactgaggcagcgacagaaatgcctgattcattgccctccaaagattgtgattcattgttaagggtcctagagagtgccgtctctgtctttggtagatattcttccagcagagagccataagactctttgcttatctgcaaagaccaggcatgcagtgcagcacttcatctcccctgagtttgcaatcatacaaagcaggaaacacagatataacagttcttgttaaacatactgtgttcatactgtcaagtcccagtatatttacaatggcatcacccattttcccaggctccaaatgtatcattgattcttaccattatctttttttttccccaagtcagagtctcactctgtttccaatgctggagtgcagtagcacaatctcgactcactgcagccttgctctcccaggctcaagcaattctcccaccttaacctctggagtagctgggactacaggcacatgccaccacacctggctaattttgtttatttttttgtagaaatgaggtctcactatgttgcccaggttggtctcgaacttctggactcaagtgatcctcccgcctcagcttcccaaagtggttgggattataggcatgagccattaatattctcttatgtcttgagttatttgtatttaaagttctattatttctttctaattttgaatagcctttttattcataatggctaagactatgtattgtgaaactagtgtcttgatttgacatctcaatcagctactcactgctgaaagttgcttcgcccctctttacctaaatttcccaatcttggaattttaatagtgtaaaatacttaaaatagtatccagcatatagtgaatactcaataaatgctaggttttattaatgtttttctttcaattccaatctcgctgtcacctccttaggttttgttcttatatttattattgattccttcatcaattcaatgaaaaattaatttgagctttatatgccagacaaatagattaccccagtaggctcctagtcattgtagtccaccttatacagcatgggtaaataattttaatgtacaactttgaccaagtcattcttgagttaaacagactaacttttagactaacttttagtctgttttattattgttttaaagttctctattgtcaatgcatccccattattgctcacacctaggacagactgctctcacacacacccccttgggtatatcattgccttttatgcttaagtccaaattctctttttaaaaataatcccaagtttttcatctgtcttttataataaggatcatctcataatactcttgtaaggatgttccatgctccaagacagctgaccctatatgtaccattcactgcactgccttgccaagaccttgccaccagctgcctgggttgctttcttcatctaaaacctgcccatacctccatatttgtgccttcacagtaacccagaggttattagctagccttggaacttatatcacacttacttatttttttgaaacagagtcttgctctgtcgcccaggctggagtgcagtggtgtgatctcagctcactgcaacctctgcctcccgggttcaagcaattctcatgcctcagcctcccaagtagcgggactacaggtgtgcaccatcacacccggctaatttttgtgtttttagtagagacggggtttcactatgttggccaggctggtctcgaactcctgacctcaagtgatccatgtgcctcagcctcccaaagtgctgggattacaggcatgagccaccgcacctgccatgtcacacttactatctttgtcacatagttaatatatgtgctttatattatgaattctttctctgcatatatactttgttctttaattcaaatgataagttgatggagattacaagttgtgttgtatgatgttcattggcacaaacaggagcttgttcaatgataatacaagggtaaatgcttttgaaataggaaaatgggcctcactgctgaattcctttacaataatttgtgtgttctagaaatgagctctgatcaccacagggtgtcactgccttacaagtcaaattttcctcaattggttgaggtgtatataggaattctcagaagacattcttgagagatcacaacaaaatgtatagatagcaatgcagccattgggagatgtggagatgctataaaatcacatagaacaaaaagtgaaaatttaatttacacactctaaacatcccctgaaatcctattcttcttccctctgttaacaatttgttgtatagccttccagatctttcctccttggagagagagagacagagaaggacaggcacaagatttagaaaacataaatgagatcctactctccgtgagcatgtgtgtgtgtggttgttcagtatcttttttaatttgataacatttcatttgccatcttttttgtctcattacatccagctttatctcattcttcttagcagctaatgcagctatttctgaatattgaaatgatcagtaattgatgtctttaatctttgaaatgtttgccttgatatagtccaaagctgtgattcagactggatttcattctgttgctcattatgtgaacactatacagttaattagcaaacacttgggagggttggtaggtggtgtgtagtaagttggaaaacagtttatgcaagccagattgccaccagaatttagaacagcataaaattaaatgccctaggtaatttacagggagtaaaggggaaaagaccgagagaaagagactgttagaataccaatgcatttttgtgtctgcattattgtttgtttctgattgtaaaataatacatgctcattgtagaagatgggaaacagaaaaatgtattaagaagaaagcaaacattaccctaatcctacaacccagacttatccacagttaatatttattgttgctcatatagcttatttcctttttcaaaatttttattatatgatacaacattatgattttaaagcatttaaaacagtacaaaagggtataaagtaaaaatgaaaagttctcttcccaccatccctggtcctcactttccacaaagtcattcactgttaacagtttctctcataatgtacatttaagtgtattgatattggctttattatgagtatacaaatgtatggtgtgtgatctatataccataatggggtcatactgcgttaatttttttatactactttttttccatttagctttctatcttgagcatacatatcctatatataattcaaatacaacccaaagattctgggcatggagctatttcaaaaagtttgacctgacactgccccccatgccattacatgcccttgagtttctaaccttacacaaaagacctgtagccttagctgagggccctttccaatgaatcacacattcatcctgtgtatatatggctctattttattttattttatttatttttttgagacaggtctcgctctctcctaggctggagtgcagtggcgcaatctcggctcactgcaagctccgcttcccgggttcacgccattctcctgcctcagcctcctgggtagctggaactacaggcgccctccacgacgcccagcttatttttttcatttttagtagagacggggtttcaccgtgttagccaggatgttctcaatatactgatctcatgatccgtccgcctctgcctctcaaagtgctgggattacaggcgtgagccaccgcaccggaccatatggctctattttagactgtttggtaggagatattagaggaacggatattataaagtgccaaagacctgagtttagatcccagttgtattggttgctagctatcttttaaaaataaaatgttttgaacaactttgtgatatatttttatcctttagagatgagaaaacagagaccaagccagggagaagtgattatataagatcacacagctagtttgtagtagagccggatcacacaaaggcctatttgaacaagaggctatgtgcttcccactctaacatcttggactttctttagaactcctgtaggtaacaatgtattgtattattgaaaatcaatgagagagtagatttcaagtgttcttaccacaaaaaaagataagtatataggtaatatgtatgttaattaactcgacttagccattccacaatgtatatacatctcaaaacatcatgttgtacatttatacagtgcttctcaatcaattaattaacttaaaagatttacaggcatatgccttcaaggttattgcctagccttttcactaaagccttgatacgagttatgtattctattatctttctagtatccgatcatcctctctctgattctcttttttttgtcacattccctttttaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacttctccactgtccagacccgtttttttcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaa

SEQ ID NO: 5696 - DNA, 120146 bp, human; identical to SEQ ID NO: 4642

SEQ ID NO: 5697 - DNA, 150566 bp, human; identical to SEQ ID NO: 4640

SEQ ID NO: 5698 - DNA, 120175 bp, human; identical to SEQ ID NO: 4638

SEQ ID NO: 5699 - DNA, 150570 bp, human; identical to SEQ ID NO: 4639

SEQ ID NO: 5700 - DNA, 117131 bp, human; identical to SEQ ID NO: 4641

SEQ ID NO: 5701 - DNA, 117126 bp, human; identical to SEQ ID NO: 4643

SEQ ID NO: 5702 - DNA, 22172 bp, human
gcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtaaggtggcgggttcggcccttttgcctgcgtgctggtggcgctgcacctcttcctttgtcgagtttctataaggccctgttctccagtcttcccctaagtcgcctaaagttgtccctctcccaaatgcctgggggaacgcggcagccatctcttgcgctaatcccgttagcggaatggaaagtaaggggttgtgcctcaacaattctcttgttatatctgtgaggtttacccattacctccaaaaagtgactttctcccaacttggagaggatgccggagggactagtgaggcctgagccagggcttaaggagtagattagtaccctagggtagatttccgattccaatggggaggaagtcttgcctgcaagacagtgtttgagtggggcgcctcagtccagttggtaagattgagttgggagccgacttacaagggataaggggctcctctagctcaatgagttgatttgggggtgaaagaaaggggtgtgtccacacaactgttgatggacagtctaccagttaggtgtcctgtatacggcctagtcagctcctcatgccctgtatactgttggatcccacagacattaccgtgtctcctcccaccttcttgttttgtgtctgttcatgctctcttgaaccagaatatgatgggtgtagcctgcaacaacctaggttctgaggtggagggtggaccagtgtaagggctctttatgatggtgctggactgtgaccctttaggtcaggcaacgaactccctctggcagtggcttctactgctgacctgatacgctgtaagctcttggatgtaactggtggcttgggcactgatgaacttagactgctctatggcatggcattggtcaggtaagacctgcatggggtaggggtggaggttggctttggggactggaggcaggggaggcatgtgataagcaaaacttggcttcaggtgttacctgaagcaaaaccctgcgtgtacctcactgtggatcagcctgtgattattgcttgacttatcagcttttggtaccctcgtcaacgcattcctctttttcttcctttttcctgaaagccttctcttccatttttctttctatcttggaatgtggaggaagggattcagaccaggtgatctctgtgggtctcttggtggtctgatattttttcttacctttgaattcctcacccagaggaacttgtctgaatggctcagggtcctcgcctgtgatttaatgtggactttccaaccctgtccctgtctattcctagcactacccttttccccttctctccctcatgaacactgaaagattgctgagttatggaagtggagacatgggctgggaattcctgacttacaaagtgactcataatggttctagctgtatacacgtcggaaaaaaaggttgctactgagttttcatatctgtcaaagtctttgcttatctatttccccttgtctgccttgagatcctccctttctcttcttattttctccattggttagctgtgctccccattatctgatgtagtcctttgcagcatttataacatattatgttctagcctaatatgttacattgtatcattattatttatcctagaccgaactgttcaaggctagagcagtgtcttattcatctgtatggcttcattatagggcagactctcattaaatgttggaatggatggaactgtccctgctctggctgacacaccagctgtaggaataggacaggacagtcggtggaaaagtggaaatgcagggtttcagtaactcagcaaagtgtttggaataaaatggttccttgggctgtgccacttatttctccctcaactccaggtttgtgaatcttatctcagagaggaagacaaagtttgccaaggtccccctcaagtgtctggctcaagaggtgcgtatgattcagtgaacttgctcaattctgtctccaagagggctcaccaaatggggcatggggtattgtgggcacacagtcagactagctcatcccatcactaccagccaagcccagcaagaatcccagagcctcagcttccagcctgaaggaggcacagttgctcccttgctctcatatgactggtatctcagagggcttggcctgcccagcttgctgggaggagcccaaatgtagcactgggtggggacaggaaagaggtgacagtcacagcacctgccctcatggagctgacagtctgagagaggagacagctcagccactatgagtcactttgtaaatcaggaattcccatcccatgtctctacttctgtaactcagacattcctaccctgaggagtatgtgaactgtgtagaggcccagagggcaggcatgctctcagtcattagcgcttcccggaggaggtgtaggagggaagcaggggtaaaggatactcagggagaaggacaggctagagggaggctggagaacgtgattgttaatgctcattcacaggtatttctttgttgtagaagggtggttggtggttaggggaggtgtgtgccttttatgtttctgattttcttttctttttttgagacagagttttgctctgttgcccaagctggagtgcagtggcgtgatcttggctcaccacaatctccgcctcccaggttcaagcaattctcgtgcctcagccacccaagtagctgggattacatttgtatttttggtagagatggggtttcaccatcttggccaggctggtctccaactcctggcctcaagtgatccacctgccctgggctcccaaagtgctgggattacaggcatgagccactgtgcctgacccacttttctgattttcaatacctcctccatagagcagtaaaaaaagaataagaagagctgtttttttttcttggctctgtcactgtgattggaatcttctttcaggacctcagtttctctagttgtaaaatggggcaggaggtggtcaggataattaatctctggctcccttccagctttaataattattttccaatttctgtactcacaccctcccctgtaatcaggtaaatattccggattggattgttgaccttcgccatgagttgacccacaagaaaatgccccatataaatgactgccgcagaggtgagtcctcagaggttatacctatcacagttaagcccaggggcctgggcttggtggcgctgagggtagagggataggcaggagggtctccacctggagtcaaggctgggactagggtgaaagaagtgaggcctcgccttgggcacaacatttaaagtggggagaagtcaaaagttccataatcaagataaataacatattaatgtggaaaaattcatgataaacataatatcaaaactttaagtaaaacgggattagtattactgatttctccttttgtttcagcttccaacatggcttggcatattttgataccttgactacagaggtttttttgcctgcccttaagttgttttttgtttgtttgtttgttttgagacgagtctcaccctgttgcccaggctggagtgcagtggcacgaccttggctcactgcaacctccacctctcgagttcaagtgattttcctgcctcagcctcttgagtagctgggtctataggcacatgctactatgtctgattaactttttttttttttttttttgagacagagtctcactctgtcacccaggctggagtgcagtggcgcaatctcagttcactgcaacctccacctcctgggttcaagtgattctcctgtctccacctcctgagtagctgggattacaggcacgcgcctccatgcctggctaattttttttttttgtatttttagtagcgatggggtttcatcatgttggtcaggctagtctcgaactcctgacctcatgatctgcccgcctcagcctcccaaagtgctaggattacaggcatgagccactgcacctggctgtatttttttagtagagctggggcttcatcatgttgcacaggctggtctcaaactcctgacctcaagtgacccgctcaccttggcctcccaaagtgctgggattataggcgtgaaccacagtgcccggccactccccttaaatgttgtttctcaggtagtgcctcattagtctcacatacctctccatagttgaggtggggaggttgccaggcatgagccatcagcagtgtcatgaacccaagggttccttggacatccaccccatcccgattaagaatcctggatttagcctcactctttgtgatgggaaaacagatctagaaaaggggagacttggccaaggccatgtaactagctaatggggctgattcctacttctgccacttactagccccttaactgtttttggcatctcgtctctaagtccaataataggtttttttttctagaaaaagtgctggtaagcaggataaagcaaagaacagggggataacccagagtgaaagaggctgcttctggatatttgagatttgaaccttggagccaagccttttcctggggccttcctataatacccacaagatgaggctggaggcctgctagctgcctgcctgatcctgtggcactgcctgccttcccccctctaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatggtaggtgttttggagggcagaaagcggcccatgagcccagaaggctcaggcttagggttaacgctgtttatttccctggctcagcatttcctctggggctgtggtgaatcttagcttaaaaaattactgtcacaaaccatcctcctggctagtttccatagtataatggctgtcacatttgcctcacaaaccatcttgagccctgtgaagtagttggggaaggaattctagttcctcaattacaactcaagaaatgaggtgagagaggctcagaatcccatcaggagaaggggtctgggctggcagtcctatctgtctccccattctgttttcagaaagagcccgagaactgctggtatcatacgaagaggagcagtttacggtaagaaagtgccctggacttggtgtgctctcatctgccccagccatttcttccctcttgccagctacctgagagaagtcttgagaaggaatttgaaagaaaagtgacaaagcgtgagggaacttctcggaaagagagaggggggaactaggaaggagacaagaggagcagagtccaattggctgatcctccacaccgatggaagggaacagatgatgaagtttgcggataatctgccccactgggtggtagggaacaactgggaatgggtagttgcgcagccctgcaattccgcagctgaccagtagatggggcccaagagcttccctaaatcaggtgagctggaggggtgctgtttttagggaggtcactcagaaaccatttagctcagcccttccttttcacagattaagaaattgaagccatggatgagtgaagggacaggcccaaagtcacatatacagttaatgatagaaccaggattagtacctggatctcccagttatctttcttctgtaactcattgcctctcctcatctctggccctttggcctaagagtctctatctccagccaaattcccccattgaacatctcagtatttacccacaggaaattcagttggaggaggaagggagggagaaggaggaggaagtctcacatttgagagtcaggctatttttagttgcaaggccagtaggggagttgtgggcccccccctgcatgccctgccctgtcccctgcagggcagtgctgagaggtcctatgggaagggatcctggaggggtggaggtgggttgcttggctgaaccagccttctgatgggaccctctttgctggcaggtgctggagaaatttaggtatttacctaaggccattaaggcgtggaataacccgtccccacgtgtagaatgtgtcctggcagagctcaagggcgttacatgcgagaacaggtgtgtaactaggtaaccgggagctgcgtattctctaggatagagggtagcagcctcattgaaatcggtttccctatcctagcttgccaacctctgctgtacaaaatcccagggataatcctgatcccctccacagtgaccctacatttggcagaactgtctgccctcaaccctgccaacttccaggtgggggttgcctatactagaatggccagaggcaggaatgcccactatcatccatctgctggccagctgctttcctgtctgtcgggtggcatgtggagctcttgacaactaggaaaatcccttgataattaccacctcactcactgcctagcccttgtctaagtttgaggtaaaagatatatgtatggtgggcactgctagtcttgtcttgttttttttttattttttatttattttttttgagaaagtgtcttgctctgttacccaggctggagtgcagtggcgcagtctcggctcactgcaacctccacctcccgggttcaagtgattctcatgcctcagccaccagagtagctgggactacagacgtgagccaccacacctggctagtttttgtattttcagtggagacagagtttcaccatgttggcgaggctggtctcaaactcctggcctcaaatgacctgcccttctggacctccgaaagtgctgggattataggcatgagccactgtgcctggccttttctctttttttacgatagggtcttgctctgtcacccaggctggagtgcagtggtgcgaacatagttaactacagcctcaacctcgcacactcaagaaatcctcccacctcagcctcctaagtagctaggaccaacaggcatgcactaccatgtctggctaattttataattttttgtagagatggggtctcaccatgttgcccaggctggtttcaagttttgggattcaagagattgtcctgccttggcctcccaaagtgctgggatcacaggtataagccactgcagccggcctggtcttttttttttttttttttttttttttttttttttttttgagacagagtttcgctattgcccacgctgcagtgcagtggcacgatcttggctcactgcaacctctgcctcccgagttcaagggattctcctgcctcagcctccccgagaagctgggactacaggcacgtaccaccacacctggctaatttttgtatttttagtagagacggggttttgccatgttggccaggctggtctggaactcttgacctcaggtgatccacctgccttggcctcccaaagtgctgggattacagatgtgagccaccacgcccgtcctggtgttttcttttgaactgccattggagagtattagcatcccttggatagtcatggttaggggaatagaggcgggaccttctcagggtctggctcctagagactaagttccttgtctctcaagtatggctgtgagcctttgtttccaaaacaaagtgctcagctcagtccagagcaggcgcatagtatgtctacccattcttctttcctccctagctcttgggggctttctacctaaattcagctggaagggctttgggggactttccgctaagaacgtgtggaggcaatgctaaacctcagctagagagaagttggagagtttaggtaggtggtgtaggtagcagagtaaccctgggtgagaactgcagtgtaggctgggattgcccctggagtcttctcttcatgtccaggatactcgttccaaaagtattttatcagtgtttgcccagcctaggtttcttggctctacccttcagcaaaagggttggtggtggcttcattagcagctgggaaaactatgcccctaacacagtagtgtctgcctggtaatgctggagagagggatctaagtatgtcaattttccaggcattaggacaacttgggagctcttttttccacgtctaggcttggtcagttaggagaatgtctatatctgtttagtgttgctataaaggaatacctgaggctgggtaattttgaagaaaagaggtttgtttgtctcatgcttctgtatcctgtatgagaagcatggtgccagcatctgcttctggttagagcttcaggctgcttcttcccctcatggcagaaggcaaaggggagtccacatgtacagatatcaaatggcaaggtggagggggagatgtcaggctcttttttaacaaccagctcttgcggaaactaatagaacaagaacttaatactgtgggaacagcaccaagtcattcatgagggatccgacccaatgacccaaaccccttctacaggcaccaaggtcaacattggggatcaaatttcaacataagatttggaggggacaaacatccaaactgtagcagaaagcctcttgggaagccactaactctggaggaatcagcttgctgttgctggtgtaggtttgagctattaacccatttatgccggaggttgcaatttctttcttttttttttttttttttttgaaaaatcagaccttggtgaagaccttgagcagtaggatataaataactcccacaagcttagcgttccaataatggaacactcggcataaatgggttaatagatagggatgagagattacccctatagcctactcctgcaacccctctaactttgttctgggtttttagaacccctagtaataaggcctatggaccatatttggtctagcagttgggtccccaaggtttctacttctaggatctaaaagaaggtagccagggagaagagaaggggtagggtactgaagaatggtcaagataaacagactgcaagaactgagtctaaaagcccttgaccccatgatcccaggcatttatttccttctgtggatgtggaactttttcctgtctgtgtgttgaagtgtattcagacactactgctctcgttatgggccatagatcagcattagtgcttggtaagcacttgttcaaaacccactgatcccagcctctaaccagcccctgcctgaggaggctgaagcctaagatccaattgtcaactcccttcctccccactcctacccacccaccacccctcctccctatgctgcttcagccacttgagccagaggcattagctgctttggaggtgggtggaggagtaggagagggtcttctgccagcatcactttgctaaactagtgtcctcttgttccagggaggctgtgctggatgcttttctggatgatggcttccttgtccccacatttgaacagttggcagctttgcagatagaatatgaaggtagggttctgggggctcactgcacccttagggttctgattcctgggtggaaacagctggggtgggctggggggccctgggttggggtgtgaaggctgtttcctgccattccatggcctctgaaagtccctcagccttcctggctgagcagaacaggtagccccactgacagttgtggggctgcccttaagtgctctggaatggggtggggtgggatggggtggggtcggggagtcttaatgacattattgtgccatgttcgttgtgatttagctgctagctagagagctagaacagcagaattggaggggccttgtgaggtcatctagtccaacatcctcatgttacagatggtcagactgaggtccagagaggggaaggtactgacccaaagtcacacagtgagttattgacaaagctgaagctagaaccagatctctgttttgtttatactttattttgagtcagttgttggttgccagatactaactggtttctctctccccactgttctgctctcctctttcctttgttctgcggtggcaactctgttgttggtggggggcttggctcatgcgcgcgcacacattctcttgctctcactctcacttcctttctcttgctgtctcttgctctctctttcgtgctctcctgctctctctctcctattgcccccccaaatgggtgtcccttacaaaccagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggtgagggagactagccctagccctagggcctaaggcagcccaggcaggagcctctgccactgtcctcagctctctgctaagaagcaccaggcaaacacctcccgtgttaaaggtttaggtttgcccaagagggccccacggcagcagtggacaaatctcccttttccttttcttctcagagccaactaaactgggctggggcaaagtgccctgaattctttgagcagttgggaggtataggtggggagtctggggggatggggagggacagagccaaactttctgaggtgaaatgttgggtggggggctcactgcttccttctccttagatcctctcttctctctcaggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatgtaagtctcttgaattccatccggtaagagggtgaggcccttcaagcctcagggccacactgccctagaatgactgagttagaagggccctttggggacagtctagcccagtctcactcccactgacagatgggacaactgagtccagagaggggaggggtagggttttcttacctaagatcatacagcttaagacctgactgaactgagtccagtgtgggaatggataagacaatccccctagagtgcttagcacagtggcctgcacagagtaagtgcacaataaatggtagctgctgtttattattgaacccaggtcttctgactccaagcccagtgctgtttcctctattatctttccaaagtatacctctgatagttgcttagcaaccttcagttgctccctattgccttcctgttaagtctaggcttcttagcctgacattcaaagatctttctgattctggcccaacttaccatggtagccatacctcctgtgagtctcctttaccctatccaccctgggttctatggtcaaactgaatattgcactggtaaatacctgtggttgtctccctttccttttctctgtcatttcctgaccctgagccacttccctcataatcatggaagcctttagcgcctgattcccttcttgctttcttgagcaatatctgtttcatttggatgactcatctgacactctacagctcctcaactccagtgactttcattctccactacactcagcaacccatttccatcattcggagctattccacctctgaaagctcacatcccagcatcccactcggtgaccaccacttctcgtccttctagttctcacccttgcatcccatgacatctgctctttgcctgcatccagatctccatccctccatttcctgcatcccttgaccttgcttcctctctatcctgtctgtggttgctcagttcggccactcatcatcagcaccttcagctttgcccatcctttggccatatctgacttgcaaacccctgagctggaattgatcctccccattctgcttcccctgctcctcagcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctgaaacccaaatctgtctagccctggcccctcccccaagattcagcctcctgtactcgactacatgtcagacatctccccttggatggcccacaggcaccttactgtgaccaaaagagaattggtcgtctcagtccccatctcaactctaaagtgatcttcctcctctgttccctatctcacttggtggcggcaccatctaccctgtcctgttgactctcgaatacttcccaaatctgaggttttgtgttgccgtgtctacttcccttagtgtctccttccctctatcagactaagcttttcaagggcaaggactctacatcagctgtccgtgccctagcacaccacacaagtctaggcaccaaacaggcctcagtaaatgtcgttgaattgaaccgtgctctgctctctcattcccagcagtgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaattaagtgtcaggcatggtgctgtgtttttttgtagaggttaacttcatttactttgacacagcagtcttgggaggtggaagtattatatattataccctatttgacagataagacattgaggctctaaggagtgatgggacttatctaatagctacacatttgttgatggtgggacagggatcttggcccaggtggtgtgagcccaaagtctaccttcatcccatcagcctgaatctgtgaccttctcagtcctgagctatgaccagacatactcgaggaagggggtgtattttaagattcgcatcacccccgcaccttagtggtcagactaatggttcgagatagcaggtgggtaatcataaacagggctgataaggcattttgccagtatcaagtgtctgggaatatttattattaatcacactaatggaccaccatgagaggacaaagtttctctctggcttttcatctgattagagctggaagcttttcaagcactttctccagccagccaatatcaatttaatttgagccactatcgtcttggaatatgaaattgcctccatagacaggatctccagtgaagtcatcagccccccagccctgcccccactgaccagtcaccctgcatatgtgaccagtctgcatgtgcccagagagaaaacagcctgctgagctcatggcccgtctgtgaaccatccgcatccatctgtgactgggtgcctgttaggtgccaggctctatgagaggctctgtgaggggtgctcaccctcctctcccctcgagctccccttcccagcagctctgtatctgttggtggttttgctgttggcgccgtcttttgtgtgcacagtgtcatcatctttaactctgcctgacccctgccatcagtcaccaagccctgctctctgtctgtctgtgtgtccttcacagcttcactccctcccatctccactgccagtgccccaggtcagccctccccgactctggcctcaactgtcggaacaggctcctccctggtctccctgcctccaggctgcctgtccaggccagcctccacatggtcacttggtgatcttcagaaacatagccttcatgtgtactcagaattggcaggtgaaccctcacacacacaccaatgcacacacttaccttcccagccctctcttcctcccacggctcctcagcacaggccgtgccctctagctgggctactcactgcacgcagcagcaccgtgtgcttgctcttgtctctgggcttcccgggccctacctcctgcacaaagccctcccttggtctttcctgccctcctcgtgctctctgtctccctcagccccgcagtgcctgcagtaggttcgcagtgctcatctggcctccctcccacatcctgctttgtcttgtcagccgctgctttttttttcttttcctccattccaggctgggctgtagctgctcccataaagggatcacagtttgtgttccacgcagaaggagcacagaacacttccaggcatatccttggagctcaagacaggttgctcagctaggccagagaagagagggatctgttcatttccagccctgcaggcctgttggctgttttgtgcatttatgtagcttttaagtgcagactaatagctatcatttattgcatgcccactatgtgccaggcactgtgccaggcattctatgtgagctttcttatttactcctcccaacaatcctatacattaggtatcattattgtcctcattttacctgagaatggaagtgaggcacagagatgaaccacagagtttgttctgggtccatggtcctgttgtttctatgttctgtctgctctactacactgcctttcagaggcaggtctggaagttcagagaccaagttcaaaccctggagtgttggggtatgaagtggcttgagattttgaatctttcctaccccatccctccctttgctcagcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcaggtaagaactactttgtccccacatggacttcttttctctttggctggctcttgaggcttccttctaccctaggaagagatggaaagtagcaggaggtagccaatgtgaggcaagcctggaaggcagcctggtgcatagatgacagctggcttctcccacctcttaggatggagcctgtgagtgccagggaccactgtcaggctgctggctacctcacataagagcacattctgagaggatgacatgggtgtgagccctgggcagtaacatagaggcagaagatagcaagaagtagggagtgtgtacatatatggttctgcacgtgtttttcacttgcagtgagacagtgctttctgtgtatgtgtgtgtgtgccttgaggctggctggtggtgagacaagattttgatgtgtgtattagaaagaaggaacctaggagaccgggcgtggtggctcatgcctgtaatcccagcactttgggaggccgaggcgggcggatcacgaggtcaggagatcgagaccatcctggctaacatggtgaaaccgtgtctctactaaaaatacaaaaaaaaaattagctgggcgtggtggcgggcgcctgtagtcccagctactcgggaggctgaggcaggagaatggcgtgaacctgggaggtggagcttgcagtgagccgagatcgcgccactgcacttcagcctgggtgacagagcgagactccgtctcaaaaaaaaaaaaaaagaaagaaagaaagaaagaaggaacctagggcattaagtcagagaaacaggaagtgagatcacaagacagaataaggaatgctgtgatttttaggtgagcacacaaattagtgaggccaaagctaggaagaggctgcagggagggttagtgatagggatctgctcttccttttgagtacccttgcttaggttaatgaacaggaacctcggaggccggaacacacagaagggatgacagaacagtgtggtgtctgtgtgctgaagcctggggagggagggagaacagctgggcctgcgtgatgtggggtgtgcagtggcagagagtgagaggggaggcagtgaatgagtttatagagaaagatactatggcctttgtttgtccttgtatggacagggtggaagggctggaacataaaacataaagtctgtctctctgtgtgtgtgtgtatgggcatgttcctgtacctgctggtcaaaccatagcccagtgacaaataacttagggcaaggagggctgtgttgggggttctttgtaaatattgaaagggaggggcattgacataagcagaatttgtgtgtgtgtgtgtgtgtgtgtgtgtgtgtgtgtgtgtgtgtataggaaaaagggaaaagtaggggcagttaagtcatggccaagcaggctgtcgtacagctttgtgaagaggaggcagggttgctgaaatccatgagggctaataggtaatctgtgtgagagagaagtgatagcattgaggttggtggctatggaggggtagtgggaacaggcagtgagatatagccatccagagatggcctgtatgttcacgccgtcactggggacatgtacaagggtatcaggctaaagaggcaggggtagtgatgtagacagcattggcgatattagtgatgacagagagatgatcgggtcagtgacagagcctatgtaggtagtggcccctgtgcacgaaggtgtctctgtatcatggagtaatgcaggacattaagacaggcacaacttccagtaagagagccaggggagggggatggacaagtagaggaacagtccttcctgaggagctctgggttacataaaaagctggtccagggttgacacattatagaatgccaggggcattatgacagggagaattctttgagtaccagggagatgcagaaggccagaaatggaatctacatggaatgcaccagtgaaggcttcatttgaaaacactgaatgcacttgtggaaggatggggagggacatttaatataatactgtgtggtaggcgtctcagtgatacgacagagagggatgggggatgtccggcatccccattctaaagtggagcatctgtatatggggggatgtgagttgtgaatgtggaaagtctagaacattaactctttccctttctcctttgccattgctccttatgtgtgtacacatgtgtggggaggtagggacaggaagattgctggttgtatgccagtgaatgaggggtgtgggaggcagggagtgaacaggacagtcactgagtgaaggacttgtgtatgtgtgcttctgtatacatatttgggtggctgtgaggggtgggatgtgtggtgagacagccgttccctagaaaaggggtgtaccttgtgcatcttggggcaagaactgcagggggcaggggaacatactatctcagggagtccaccctgagttgggcatgggggtgtgtgtgtatctctgcattaagaaaatatgtggtattcaaacaggcaggggagtgtgtgtgtagatttgtaggaaatctaggtcattcagctactctgaggtactggtgggtttggggtttgagggggaggtgctttgggaattctgggacatccagaccctccatgatgtgtccctgtgtgtgtgtctacagacagggaaataggggtgaagatgaaaagttgaagcagtgatacagcctggtcagaagttgttgtttgtgtccgtgtggaacatgcctggggaagtaggaaaagagcaaagagggacaaaaatgtctgtagttgtatacttgtatatgtaagcacatagagggggagaaggaccataaagaatgtgtggtgaagcactctggtggagaggggctcatgagaagtgataccgagagcagtgaagctggagatcctgagagagcccacctgtgctaagtggggtgggtggatggacagggtgagcaggcctgtgcaccagtcggagaaccagctcatcagcccagtcttgccacttccctttgctccacagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgagtgagtgcccatggcaacaggatttctcaccccctttctctgccacctgtgggagggagagaagacaaggtgaggtgggtgggggaggtagctgtccccagtcagggcctaaatgagtgaagtgtaagccccagtccctggctgggcccttgccagctctccctgtccctagtgtggggagccagtgaagtagccacacacagctgggcttggcatccctctcagattgcattcagtttgtgcttatggatggacgtgtgtgtgtgtgtgtgtgtgtgtgtgtgtgtgcaggcacacacacacattttgggaggagaagggtccatagctttcagcagattctctaactggtccaccactcctaaaaagtcaaaaatagatgctctcatccagctttttcacgttactgaggagaaaactgaggcccagaaaggggaagggatttgtctaatggtgcatagagtaatcagtaggcctccccacactgtccaggcaccttggtagcaaggcctgcacggggcttcatgctctccctcaaaactcgcctctggatcacaggcgtgggagcccttgggtcaccagggagccaggaaccaagcagcccttgctgaggggctatgctagtaacacaaaggagcccatccaaagggcctgtacattccagaatgctgggccattctgaccagataatcctgtgagtactagagaggaacccctgcgggcccctgaaactaagtctttccctttgctgcctgcccactccctgggagatgaacccctcttcatctgggcattctgggaaagggctatagaatccaggggccccagaagcaggccagacccaaggcaatgccatggactctgtccaaggccatgggccagcaggcctcttggagaagagaggtggcagctggggaagccaggagatctgtagttgggagtgggattcacatgtctgagagaggtgcccttacccctccttcccaaccagcctggccctgggtaaggatggcttattgagtaccatggatagcaagggtgaagtgtgggcagctggagctgttcagtcaagaaggaagctgattcagcccagctcccacacccactgtagtagggacgtttcctttgctgtggaggggcatgcccacccctgcttcttgtctcagctccacccctgacttggctatgtggccttgggaaagtccattcccatctctgggcctcagttaacttgtctgtaagattgtgggtgatgggaggtggtggaactagattatccgtaagggttctttcagctgcagtagtgtaaccatggatctgcctgagggtagggtgatggctttgctctcagctgtcaccctcacccagctggaaggaccttgacttgcgggaagcaggggaagcaagagtgttatgagcagggccagggagaaggagggcagagccaccctccctaaagcaatcttgcaatcgtgggcctagtcttatagcccaagcctggccttgggccccttaaccaggtgttgggtgtgggagggatccaggcccccaagctctaaggccttgaaaggatgtcctgttaaggcagctactttcaatgtcttgggagtcaggttatgtggggccccctcccctacctcaacccaaacagctctgctttaatctggtttatctactagggctctgcataaaacttcatttgaaaagttcttgcctccttccctcccttcctcaactgaggagagggccaagtcaaccctggggcccacacgaagtcgtttctcggatttgctccagtctctttgtaaagccaggcaggagagtgggcccatcccacagatacacacatgtcaagcactcttggcccctccagagcctaaagctgcctccttccctgactgacctcccactctctcctcagcaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 5703 - DNA, 22174 bp, human
gtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtaaggtggcgggttcggcccttttgcctgcgtgctggtggcgctgcacctcttcctttgtcgagtttctataaggccctgttctccagtcttcccctaagtcgcctaaagttgtccctctcccaaatgcctgggggaacgcggcagccatctcttgcgctaatcccgttagcggaatggaaagtaaggggttgtgcctcaacaattctcttgttatatctgtgaggtttacccattacctccaaaaagtgactttctcccaacttggagaggatgccggagggactagtgaggcctgagccagggcttaaggagtagattagtaccctagggtagatttccgattccaatggggaggaagtcttgcctgcaagacagtgtttgagtggggcgcctcagtccagttggtaagattgagttgggagccgacttacaagggataaggggctcctctagctcaatgagttgatttgggggtgaaagaaaggggtgtgtccacacaactgttgatggacagtctaccagttaggtgtcctgtatacggcctagtcagctcctcatgccctgtatactgttggatcccacagacattaccgtgtctcctcccaccttcttgttttgtgtctgttcatgctctcttgaaccagaatatgatgggtgtagcctgcaacaacctaggttctgaggtggagggtggaccagtgtaagggctctttatgatggtgctggactgtgaccctttaggtcaggcaacgaactccctctggcagtggcttctactgctgacctgatacgctgtaagctcttggatgtaactggtggcttgggcactgatgaacttagactgctctatggcatggcattggtcaggtaagacctgcatggggtaggggtggaggttggctttggggactggaggcaggggaggcatgtgataagcaaaacttggcttcaggtgttacctgaagcaaaaccctgcgtgtacctcactgtggatcagcctgtgattattgcttgacttatcagcttttggtaccctcgtcaacgcattcctctttttcttcctttttcctgaaagccttctcttccatttttctttctatcttggaatgtggaggaagggattcagaccaggtgatctctgtgggtctcttggtggtctgatattttttcttacctttgaattcctcacccagaggaacttgtctgaatggctcagggtcctcgcctgtgatttaatgtggactttccaaccctgtccctgtctattcctagcactacccttttccccttctctccctcatgaacactgaaagattgctgagttatggaagtggagacatgggctgggaattcctgacttacaaagtgactcataatggttctagctgtatacacgtcggaaaaaaaggttgctactgagttttcatatctgtcaaagtctttgcttatctatttccccttgtctgccttgagatcctccctttctcttcttattttctccattggttagctgtgctccccattatctgatgtagtcctttgcagcatttataacatattatgttctagcctaatatgttacattgtatcattattatttatcctagaccgaactgttcaaggctagagcagtgtcttattcatctgtatggcttcattatagggcagactctcattaaatgttggaatggatggaactgtccctgctctggctgacacaccagctgtaggaataggacaggacagtcggtggaaaagtggaaatgcagggtttcagtaactcagcaaagtgtttggaataaaatggttccttgggctgtgccacttatttctccctcaactccaggtttgtgaatcttatctcagagaggaagacaaagtttgccaaggtccccctcaagtgtctggctcaagaggtgcgtatgattcagtgaacttgctcaattctgtctccaagagggctcaccaaatggggcatggggtattgtgggcacacagtcagactagctcatcccatcactaccagccaagcccagcaagaatcccagagcctcagcttccagcctgaaggaggcacagttgctcccttgctctcatatgactggtatctcagagggcttggcctgcccagcttgctgggaggagcccaaatgtagcactgggtggggacaggaaagaggtgacagtcacagcacctgccctcatggagctgacagtctgagagaggagacagctcagccactatgagtcactttgtaaatcaggaattcccatcccatgtctctacttctgtaactcagacattcctaccctgaggagtatgtgaactgtgtagaggcccagagggcaggcatgctctcagtcattagcgcttcccggaggaggtgtaggagggaagcaggggtaaaggatactcagggagaaggacaggctagagggaggctggagaacgtgattgttaatgctcattcacaggtatttctttgttgtagaagggtggttggtggttaggggaggtgtgtgccttttatgtttctgattttcttttctttttttgagacagagttttgctctgttgcccaagctggagtgcagtggcgtgatcttggctcaccacaatctccgcctcccaggttcaagcaattctcgtgcctcagccacccaagtagctgggattacatttgtatttttggtagagatggggtttcaccatcttggccaggctggtctccaactcctggcctcaagtgatccacctgccctgggctcccaaagtgctgggattacaggcatgagccactgtgcctgacccacttttctgattttcaatacctcctccatagagcagtaaaaaaagaataagaagagctgtttttttttcttggctctgtcactgtgattggaatcttctttcaggacctcagtttctctagttgtaaaatggggcaggaggtggtcaggataattaatctctggctcccttccagctttaataattattttccaatttctgtactcacaccctcccctgtaatcaggtaaatattccggattggattgttgaccttcgccatgagttgacccacaagaaaatgccccatataaatgactgccgcagaggtgagtcctcagaggttatacctatcacagttaagcccaggggcctgggcttggtggcgctgagggtagagggataggcaggagggtctccacctggagtcaaggctgggactagggtgaaagaagtgaggcctcgccttgggcacaacatttaaagtggggagaagtcaaaagttccataatcaagataaataacatattaatgtggaaaaattcatgataaacataatatcaaaactttaagtaaaacgggattagtattactgatttctccttttgtttcagcttccaacatggcttggcatattttgataccttgactacagaggtttttttgcctgcccttaagttgttttttgtttgtttgtttgttttgagacgagtctcaccctgttgcccaggctggagtgcagtggcacgaccttggctcactgcaacctccacctctcgagttcaagtgattttcctgcctcagcctcttgagtagctgggtctataggcacatgctactatgtctgattaactttttttttttttttttttgagacagagtctcactctgtcacccaggctggagtgcagtggcgcaatctcagttcactgcaacctccacctcctgggttcaagtgattctcctgtctccacctcctgagtagctgggattacaggcacgcgcctccatgcctggctaattttttttttttgtatttttagtagcgatggggtttcatcatgttggtcaggctagtctcgaactcctgacctcatgatctgcccgcctcagcctcccaaagtgctaggattacaggcatgagccactgcacctggctgtatttttttagtagagctggggcttcatcatgttgcacaggctggtctcaaactcctgacctcaagtgacccgctcaccttggcctcccaaagtgctgggattataggcgtgaaccacagtgcccggccactccccttaaatgttgtttctcaggtagtgcctcattagtctcacatacctctccatagttgaggtggggaggttgccaggcatgagccatcagcagtgtcatgaacccaagggttccttggacatccaccccatcccgattaagaatcctggatttagcctcactctttgtgatgggaaaacagatctagaaaaggggagacttggccaaggccatgtaactagctaatggggctgattcctacttctgccacttactagccccttaactgtttttggcatctcgtctctaagtccaataataggtttttttttctagaaaaagtgctggtaagcaggataaagcaaagaacagggggataacccagagtgaaagaggctgcttctggatatttgagatttgaaccttggagccaagccttttcctggggccttcctataatacccacaagatgaggctggaggcctgctagctgcctgcctgatcctgtggcactgcctgccttcccccctctaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatggtaggtgttttggagggcagaaagcggcccatgagcccagaaggctcaggcttagggttaacgctgtttatttccctggctcagcatttcctctggggctgtggtgaatcttagcttaaaaaattactgtcacaaaccatcctcctggctagtttccatagtataatggctgtcacatttgcctcacaaaccatcttgagccctgtgaagtagttggggaaggaattctagttcctcaattacaactcaagaaatgaggtgagagaggctcagaatcccatcaggagaaggggtctgggctggcagtcctatctgtctccccattctgttttcagaaagagcccgagaactgctggtatcatacgaagaggagcagtttacggtaagaaagtgccctggacttggtgtgctctcatctgccccagccatttcttccctcttgccagctacctgagagaagtcttgagaaggaatttgaaagaaaagtgacaaagcgtgagggaacttctcggaaagagagaggggggaactaggaaggagacaagaggagcagagtccaattggctgatcctccacaccgatggaagggaacagatgatgaagtttgcggataatctgccccactgggtggtagggaacaactgggaatgggtagttgcgcagccctgcaattccgcagctgaccagtagatggggcccaagagcttccctaaatcaggtgagctggaggggtgctgtttttagggaggtcactcagaaaccatttagctcagcccttccttttcacagattaagaaattgaagccatggatgagtgaagggacaggcccaaagtcacatatacagttaatgatagaaccaggattagtacctggatctcccagttatctttcttctgtaactcattgcctctcctcatctctggccctttggcctaagagtctctatctccagccaaattcccccattgaacatctcagtatttacccacaggaaattcagttggaggaggaagggagggagaaggaggaggaagtctcacatttgagagtcaggctatttttagttgcaaggccagtaggggagttgtgggcccccccctgcatgccctgccctgtcccctgcagggcagtgctgagaggtcctatgggaagggatcctggaggggtggaggtgggttgcttggctgaaccagccttctgatgggaccctctttgctggcaggtgctggagaaatttaggtatttacctaaggccattaaggcgtggaataacccgtccccacgtgtagaatgtgtcctggcagagctcaagggcgttacatgcgagaacaggtgtgtaactaggtaaccgggagctgcgtattctctaggatagagggtagcagcctcattgaaatcggtttccctatcctagcttgccaacctctgctgtacaaaatcccagggataatcctgatcccctccacagtgaccctacatttggcagaactgtctgccctcaaccctgccaacttccaggtgggggttgcctatactagaatggccagaggcaggaatgcccactatcatccatctgctggccagctgctttcctgtctgtcgggtggcatgtggagctcttgacaactaggaaaatcccttgataattaccacctcactcactgcctagcccttgtctaagtttgaggtaaaagatatatgtatggtgggcactgctagtcttgtcttgttttttttttattttttatttattttttttgagaaagtgtcttgctctgttacccaggctggagtgcagtggcgcagtctcggctcactgcaacctccacctcccgggttcaagtgattctcatgcctcagccaccagagtagctgggactacagacgtgagccaccacacctggctagtttttgtattttcagtggagacagagtttcaccatgttggcgaggctggtctcaaactcctggcctcaaatgacctgcccttctggacctccgaaagtgctgggattataggcatgagccactgtgcctggccttttctctttttttacgatagggtcttgctctgtcacccaggctggagtgcagtggtgcgaacatagttaactacagcctcaacctcgcacactcaagaaatcctcccacctcagcctcctaagtagctaggaccaacaggcatgcactaccatgtctggctaattttataattttttgtagagatggggtctcaccatgttgcccaggctggtttcaagttttgggattcaagagattgtcctgccttggcctcccaaagtgctgggatcacaggtataagccactgcagccggcctggtcttttttttttttttttttttttttttttttttttttttgagacagagtttcgctattgcccacgctgcagtgcagtggcacgatcttggctcactgcaacctctgcctcccgagttcaagggattctcctgcctcagcctccccgagaagctgggactacaggcacgtaccaccacacctggctaatttttgtatttttagtagagacggggttttgccatgttggccaggctggtctggaactcttgacctcaggtgatccacctgccttggcctcccaaagtgctgggattacagatgtgagccaccacgcccgtcctggtgttttcttttgaactgccattggagagtattagcatcccttggatagtcatggttaggggaatagaggcgggaccttctcagggtctggctcctagagactaagttccttgtctctcaagtatggctgtgagcctttgtttccaaaacaaagtgctcagctcagtccagagcaggcgcatagtatgtctacccattcttctttcctccctagctcttgggggctttctacctaaattcagctggaagggctttgggggactttccgctaagaacgtgtggaggcaatgctaaacctcagctagagagaagttggagagtttaggtaggtggtgtaggtagcagagtaaccctgggtgagaactgcagtgtaggctgggattgcccctggagtcttctcttcatgtccaggatactcgttccaaaagtattttatcagtgtttgcccagcctaggtttcttggctctacccttcagcaaaagggttggtggtggcttcattagcagctgggaaaactatgcccctaacacagtagtgtctgcctggtaatgctggagagagggatctaagtatgtcaattttccaggcattaggacaacttgggagctcttttttccacgtctaggcttggtcagttaggagaatgtctatatctgtttagtgttgctataaaggaatacctgaggctgggtaattttgaagaaaagaggtttgtttgtctcatgcttctgtatcctgtatgagaagcatggtgccagcatctgcttctggttagagcttcaggctgcttcttcccctcatggcagaaggcaaaggggagtccacatgtacagatatcaaatggcaaggtggagggggagatgtcaggctcttttttaacaaccagctcttgcggaaactaatagaacaagaacttaatactgtgggaacagcaccaagtcattcatgagggatccgacccaatgacccaaaccccttctacaggcaccaaggtcaacattggggatcaaatttcaacataagatttggaggggacaaacatccaaactgtagcagaaagcctcttgggaagccactaactctggaggaatcagcttgctgttgctggtgtaggtttgagctattaacccatttatgccggaggttgcaatttctttcttttttttttttttttttttgaaaaatcagaccttggtgaagaccttgagcagtaggatataaataactcccacaagcttagcgttccaataatggaacactcggcataaatgggttaatagatagggatgagagattacccctatagcctactcctgcaacccctctaactttgttctgggtttttagaacccctagtaataaggcctatggaccatatttggtctagcagttgggtccccaaggtttctacttctaggatctaaaagaaggtagccagggagaagagaaggggtagggtactgaagaatggtcaagataaacagactgcaagaactgagtctaaaagcccttgaccccatgatcccaggcatttatttccttctgtggatgtggaactttttcctgtctgtgtgttgaagtgtattcagacactactgctctcgttatgggccatagatcagcattagtgcttggtaagcacttgttcaaaacccactgatcccagcctctaaccagcccctgcctgaggaggctgaagcctaagatccaattgtcaactcccttcctccccactcctacccacccaccacccctcctccctatgctgcttcagccacttgagccagaggcattagctgctttggaggtgggtggaggagtaggagagggtcttctgccagcatcactttgctaaactagtgtcctcttgttccagggaggctgtgctggatgcttttctggatgatggcttccttgtccccacatttgaacagttggcagctttgcagatagaatatgaaggtagggttctgggggctcactgcacccttagggttctgattcctgggtggaaacagctggggtgggctggggggccctgggttggggtgtgaaggctgtttcctgccattccatggcctctgaaagtccctcagccttcctggctgagcagaacaggtagccccactgacagttgtggggctgcccttaagtgctctggaatggggtggggtgggatggggtggggtcggggagtcttaatgacattattgtgccatgttcgttgtgatttagctgctagctagagagctagaacagcagaattggaggggccttgtgaggtcatctagtccaacatcctcatgttacagatggtcagactgaggtccagagaggggaaggtactgacccaaagtcacacagtgagttattgacaaagctgaagctagaaccagatctctgttttgtttatactttattttgagtcagttgttggttgccagatactaactggtttctctctccccactgttctgctctcctctttcctttgttctgcggtggcaactctgttgttggtggggggcttggctcatgcgcgcgcacacattctcttgctctcactctcacttcctttctcttgctgtctcttgctctctctttcgtgctctcctgctctctctctcctattgcccccccaaatgggtgtcccttacaaaccagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggtgagggagactagccctagccctagggcctaaggcagcccaggcaggagcctctgccactgtcctcagctctctgctaagaagcaccaggcaaacacctcccgtgttaaaggtttaggtttgcccaagagggccccacggcagcagtggacaaatctcccttttccttttcttctcagagccaactaaactgggctggggcaaagtgccctgaattctttgagcagttgggaggtataggtggggagtctggggggatggggagggacagagccaaactttctgaggtgaaatgttgggtggggggctcactgcttccttctccttagatcctctcttctctctcaggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatgtaagtctcttgaattccatccggtaagagggtgaggcccttcaagcctcagggccacactgccctagaatgactgagttagaagggccctttggggacagtctagcccagtctcactcccactgacagatgggacaactgagtccagagaggggaggggtagggttttcttacctaagatcatacagcttaagacctgactgaactgagtccagtgtgggaatggataagacaatccccctagagtgcttagcacagtggcctgcacagagtaagtgcacaataaatggtagctgctgtttattattgaacccaggtcttctgactccaagcccagtgctgtttcctctattatctttccaaagtatacctctgatagttgcttagcaaccttcagttgctccctattgccttcctgttaagtctaggcttcttagcctgacattcaaagatctttctgattctggcccaacttaccatggtagccatacctcctgtgagtctcctttaccctatccaccctgggttctatggtcaaactgaatattgcactggtaaatacctgtggttgtctccctttccttttctctgtcatttcctgaccctgagccacttccctcataatcatggaagcctttagcgcctgattcccttcttgctttcttgagcaatatctgtttcatttggatgactcatctgacactctacagctcctcaactccagtgactttcattctccactacactcagcaacccatttccatcattcggagctattccacctctgaaagctcacatcccagcatcccactcggtgaccaccacttctcgtccttctagttctcacccttgcatcccatgacatctgctctttgcctgcatccagatctccatccctccatttcctgcatcccttgaccttgcttcctctctatcctgtctgtggttgctcagttcggccactcatcatcagcaccttcagctttgcccatcctttggccatatctgacttgcaaacccctgagctggaattgatcctccccattctgcttcccctgctcctcagcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctgaaacccaaatctgtctagccctggcccctcccccaagattcagcctcctgtactcgactacatgtcagacatctccccttggatggcccacaggcaccttactgtgaccaaaagagaattggtcgtctcagtccccatctcaactctaaagtgatcttcctcctctgttccctatctcacttggtggcggcaccatctaccctgtcctgttgactctcgaatacttcccaaatctgaggttttgtgttgccgtgtctacttcccttagtgtctccttccctctatcagactaagcttttcaagggcaaggactctacatcagctgtccgtgccctagcacaccacacaagtctaggcaccaaacaggcctcagtaaatgtcgttgaattgaaccgtgctctgctctctcattcccagcagtgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaattaagtgtcaggcatggtgctgtgtttttttgtagaggttaacttcatttactttgacacagcagtcttgggaggtggaagtattatatattataccctatttgacagataagacattgaggctctaaggagtgatgggacttatctaatagctacacatttgttgatggtgggacagggatcttggcccaggtggtgtgagcccaaagtctaccttcatcccatcagcctgaatctgtgaccttctcagtcctgagctatgaccagacatactcgaggaagggggtgtattttaagattcgcatcacccccgcaccttagtggtcagactaatggttcgagatagcaggtgggtaatcataaacagggctgataaggcattttgccagtatcaagtgtctgggaatatttattattaatcacactaatggaccaccatgagaggacaaagtttctctctggcttttcatctgattagagctggaagcttttcaagcactttctccagccagccaatatcaatttaatttgagccactatcgtcttggaatatgaaattgcctccatagacaggatctccagtgaagtcatcagccccccagccctgcccccactgaccagtcaccctgcatatgtgaccagtctgcatgtgcccagagagaaaacagcctgctgagctcatggcccgtctgtgaaccatccgcatccatctgtgactgggtgcctgttaggtgccaggctctatgagaggctctgtgaggggtgctcaccctcctctcccctcgagctccccttcccagcagctctgtatctgttggtggttttgctgttggcgccgtcttttgtgtgcacagtgtcatcatctttaactctgcctgacccctgccatcagtcaccaagccctgctctctgtctgtctgtgtgtccttcacagcttcactccctcccatctccactgccagtgccccaggtcagccctccccgactctggcctcaactgtcggaacaggctcctccctggtctccctgcctccaggctgcctgtccaggccagcctccacatggtcacttggtgatcttcagaaacatagccttcatgtgtactcagaattggcaggtgaaccctcacacacacaccaatgcacacacttaccttcccagccctctcttcctcccacggctcctcagcacaggccgtgccctctagctgggctactcactgcacgcagcagcaccgtgtgcttgctcttgtctctgggcttcccgggccctacctcctgcacaaagccctcccttggtctttcctgccctcctcgtgctctctgtctccctcagccccgcagtgcctgcagtaggttcgcagtgctcatctggcctccctcccacatcctgctttgtcttgtcagccgctgctttttttttcttttcctccattccaggctgggctgtagctgctcccataaagggatcacagtttgtgttccacgcagaaggagcacagaacacttccaggcatatccttggagctcaagacaggttgctcagctaggccagagaagagagggatctgttcatttccagccctgcaggcctgttggctgttttgtgcatttatgtagcttttaagtgcagactaatagctatcatttattgcatgcccactatgtgccaggcactgtgccaggcattctatgtgagctttcttatttactcctcccaacaatcctatacattaggtatcattattgtcctcattttacctgagaatggaagtgaggcacagagatgaaccacagagtttgttctgggtccatggtcctgttgtttctatgttctgtctgctctactacactgcctttcagaggcaggtctggaagttcagagaccaagttcaaaccctggagtgttggggtatgaagtggcttgagattttgaatctttcctaccccatccctccctttgctcagcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcaggtaagaactactttgtccccacatggacttcttttctctttggctggctcttgaggcttccttctaccctaggaagagatggaaagtagcaggaggtagccaatgtgaggcaagcctggaaggcagcctggtgcatagatgacagctggcttctcccacctcttaggatggagcctgtgagtgccagggaccactgtcaggctgctggctacctcacataagagcacattctgagaggatgacatgggtgtgagccctgggcagtaacatagaggcagaagatagcaagaagtagggagtgtgtacatatatggttctgcacgtgtttttcacttgcagtgagacagtgctttctgtgtatgtgtgtgtgtgccttgaggctggctggtggtgagacaagattttgatgtgtgtattagaaagaaggaacctaggagaccgggcgtggtggctcatgcctgtaatcccagcactttgggaggccgaggcgggcggatcacgaggtcaggagatcgagaccatcctggctaacatggtgaaaccgtgtctctactaaaaatacaaaaaaaaaattagctgggcgtggtggcgggcgcctgtagtcccagctactcgggaggctgaggcaggagaatggcgtgaacctgggaggtggagcttgcagtgagccgagatcgcgccactgcacttcagcctgggtgacagagcgagactccgtctcaaaaaaaaaaaaaaagaaagaaagaaagaaagaaggaacctagggcattaagtcagagaaacaggaagtgagatcacaagacagaataaggaatgctgtgatttttaggtgagcacacaaattagtgaggccaaagctaggaagaggctgcagggagggttagtgatagggatctgctcttccttttgagtacccttgcttaggttaatgaacaggaacctcggaggccggaacacacagaagggatgacagaacagtgtggtgtctgtgtgctgaagcctggggagggagggagaacagctgggcctgcgtgatgtggggtgtgcagtggcagagagtgagaggggaggcagtgaatgagtttatagagaaagatactatggcctttgtttgtccttgtatggacagggtggaagggctggaacataaaacataaagtctgtctctctgtgtgtgtgtgtatgggcatgttcctgtacctgctggtcaaaccatagcccagtgacaaataacttagggcaaggagggctgtgttgggggttctttgtaaatattgaaagggaggggcattgacataagcagaatttgtgtgtgtgtgtgtgtgtgtgtgtgtgtgtgtgtgtgtgtgtataggaaaaagggaaaagtaggggcagttaagtcatggccaagcaggctgtcgtacagctttgtgaagaggaggcagggttgctgaaatccatgagggctaataggtaatctgtgtgagagagaagtgatagcattgaggttggtggctatggaggggtagtgggaacaggcagtgagatatagccatccagagatggcctgtatgttcacgccgtcactggggacatgtacaagggtatcaggctaaagaggcaggggtagtgatgtagacagcattggcgatattagtgatgacagagagatgatcgggtcagtgacagagcctatgtaggtagtggcccctgtgcacgaaggtgtctctgtatcatggagtaatgcaggacattaagacaggcacaacttccagtaagagagccaggggagggggatggacaagtagaggaacagtccttcctgaggagctctgggttacataaaaagctggtccagggttgacacattatagaatgccaggggcattatgacagggagaattctttgagtaccagggagatgcagaaggccagaaatggaatctacatggaatgcaccagtgaaggcttcatttgaaaacactgaatgcacttgtggaaggatggggagggacatttaatataatactgtgtggtaggcgtctcagtgatacgacagagagggatgggggatgtccggcatccccattctaaagtggagcatctgtatatggggggatgtgagttgtgaatgtggaaagtctagaacattaactctttccctttctcctttgccattgctccttatgtgtgtacacatgtgtggggaggtagggacaggaagattgctggttgtatgccagtgaatgaggggtgtgggaggcagggagtgaacaggacagtcactgagtgaaggacttgtgtatgtgtgcttctgtatacatatttgggtggctgtgaggggtgggatgtgtggtgagacagccgttccctagaaaaggggtgtaccttgtgcatcttggggcaagaactgcagggggcaggggaacatactatctcagggagtccaccctgagttgggcatgggggtgtgtgtgtatctctgcattaagaaaatatgtggtattcaaacaggcaggggagtgtgtgtgtagatttgtaggaaatctaggtcattcagctactctgaggtactggtgggtttggggtttgagggggaggtgctttgggaattctgggacatccagaccctccatgatgtgtccctgtgtgtgtgtctacagacagggaaataggggtgaagatgaaaagttgaagcagtgatacagcctggtcagaagttgttgtttgtgtccgtgtggaacatgcctggggaagtaggaaaagagcaaagagggacaaaaatgtctgtagttgtatacttgtatatgtaagcacatagagggggagaaggaccataaagaatgtgtggtgaagcactctggtggagaggggctcatgagaagtgataccgagagcagtgaagctggagatcctgagagagcccacctgtgctaagtggggtgggtggatggacagggtgagcaggcctgtgcaccagtcggagaaccagctcatcagcccagtcttgccacttccctttgctccacagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgagtgagtgcccatggcaacaggatttctcaccccctttctctgccacctgtgggagggagagaagacaaggtgaggtgggtgggggaggtagctgtccccagtcagggcctaaatgagtgaagtgtaagccccagtccctggctgggcccttgccagctctccctgtccctagtgtggggagccagtgaagtagccacacacagctgggcttggcatccctctcagattgcattcagtttgtgcttatggatggacgtgtgtgtgtgtgtgtgtgtgtgtgtgtgtgtgcaggcacacacacacattttgggaggagaagggtccatagctttcagcagattctctaactggtccaccactcctaaaaagtcaaaaatagatgctctcatccagctttttcacgttactgaggagaaaactgaggcccagaaaggggaagggatttgtctaatggtgcatagagtaatcagtaggcctccccacactgtccaggcaccttggtagcaaggcctgcacggggcttcatgctctccctcaaaactcgcctctggatcacaggcgtgggagcccttgggtcaccagggagccaggaaccaagcagcccttgctgaggggctatgctagtaacacaaaggagcccatccaaagggcctgtacattccagaatgctgggccattctgaccagataatcctgtgagtactagagaggaacccctgcgggcccctgaaactaagtctttccctttgctgcctgcccactccctgggagatgaacccctcttcatctgggcattctgggaaagggctatagaatccaggggccccagaagcaggccagacccaaggcaatgccatggactctgtccaaggccatgggccagcaggcctcttggagaagagaggtggcagctggggaagccaggagatctgtagttgggagtgggattcacatgtctgagagaggtgcccttacccctccttcccaaccagcctggccctgggtaaggatggcttattgagtaccatggatagcaagggtgaagtgtgggcagctggagctgttcagtcaagaaggaagctgattcagcccagctcccacacccactgtagtagggacgtttcctttgctgtggaggggcatgcccacccctgcttcttgtctcagctccacccctgacttggctatgtggccttgggaaagtccattcccatctctgggcctcagttaacttgtctgtaagattgtgggtgatgggaggtggtggaactagattatccgtaagggttctttcagctgcagtagtgtaaccatggatctgcctgagggtagggtgatggctttgctctcagctgtcaccctcacccagctggaaggaccttgacttgcgggaagcaggggaagcaagagtgttatgagcagggccagggagaaggagggcagagccaccctccctaaagcaatcttgcaatcgtgggcctagtcttatagcccaagcctggccttgggccccttaaccaggtgttgggtgtgggagggatccaggcccccaagctctaaggccttgaaaggatgtcctgttaaggcagctactttcaatgtcttgggagtcaggttatgtggggccccctcccctacctcaacccaaacagctctgctttaatctggtttatctactagggctctgcataaaacttcatttgaaaagttcttgcctccttccctcccttcctcaactgaggagagggccaagtcaaccctggggcccacacgaagtcgtttctcggatttgctccagtctctttgtaaagccaggcaggagagtgggcccatcccacagatacacacatgtcaagcactcttggcccctccagagcctaaagctgcctccttccctgactgacctcccactctctcctcagcaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 5704 - DNA, 22173 bp, human
gtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtaaggtggcgggttcggcccttttgcctgcgtgctggtggcgctgcacctcttcctttgtcgagtttctataaggccctgttctccagtcttcccctaagtcgcctaaagttgtccctctcccaaatgcctgggggaacgcggcagccatctcttgcgctaatcccgttagcggaatggaaagtaaggggttgtgcctcaacaattctcttgttatatctgtgaggtttacccattacctccaaaaagtgactttctcccaacttggagaggatgccggagggactagtgaggcctgagccagggcttaaggagtagattagtaccctagggtagatttccgattccaatggggaggaagtcttgcctgcaagacagtgtttgagtggggcgcctcagtccagttggtaagattgagttgggagccgacttacaagggataaggggctcctctagctcaatgagttgatttgggggtgaaagaaaggggtgtgtccacacaactgttgatggacagtctaccagttaggtgtcctgtatacggcctagtcagctcctcatgccctgtatactgttggatcccacagacattaccgtgtctcctcccaccttcttgttttgtgtctgttcatgctctcttgaaccagaatatgatgggtgtagcctgcaacaacctaggttctgaggtggagggtggaccagtgtaagggctctttatgatggtgctggactgtgaccctttaggtcaggcaacgaactccctctggcagtggcttctactgctgacctgatacgctgtaagctcttggatgtaactggtggcttgggcactgatgaacttagactgctctatggcatggcattggtcaggtaagacctgcatggggtaggggtggaggttggctttggggactggaggcaggggaggcatgtgataagcaaaacttggcttcaggtgttacctgaagcaaaaccctgcgtgtacctcactgtggatcagcctgtgattattgcttgacttatcagcttttggtaccctcgtcaacgcattcctctttttcttcctttttcctgaaagccttctcttccatttttctttctatcttggaatgtggaggaagggattcagaccaggtgatctctgtgggtctcttggtggtctgatattttttcttacctttgaattcctcacccagaggaacttgtctgaatggctcagggtcctcgcctgtgatttaatgtggactttccaaccctgtccctgtctattcctagcactacccttttccccttctctccctcatgaacactgaaagattgctgagttatggaagtggagacatgggctgggaattcctgacttacaaagtgactcataatggttctagctgtatacacgtcggaaaaaaaggttgctactgagttttcatatctgtcaaagtctttgcttatctatttccccttgtctgccttgagatcctccctttctcttcttattttctccattggttagctgtgctccccattatctgatgtagtcctttgcagcatttataacatattatgttctagcctaatatgttacattgtatcattattatttatcctagaccgaactgttcaaggctagagcagtgtcttattcatctgtatggcttcattatagggcagactctcattaaatgttggaatggatggaactgtccctgctctggctgacacaccagctgtaggaataggacaggacagtcggtggaaaagtggaaatgcagggtttcagtaactcagcaaagtgtttggaataaaatggttccttgggctgtgccacttatttctccctcaactccaggtttgtgaatcttatctcagagaggaagacaaagtttgccaaggtccccctcaagtgtctggctcaagaggtgcgtatgattcagtgaacttgctcaattctgtctccaagagggctcaccaaatggggcatggggtattgtgggcacacagtcagactagctcatcccatcactaccagccaagcccagcaagaatcccagagcctcagcttccagcctgaaggaggcacagttgctcccttgctctcatatgactggtatctcagagggcttggcctgcccagcttgctgggaggagcccaaatgtagcactgggtggggacaggaaagaggtgacagtcacagcacctgccctcatggagctgacagtctgagagaggagacagctcagccactatgagtcactttgtaaatcaggaattcccatcccatgtctctacttctgtaactcagacattcctaccctgaggagtatgtgaactgtgtagaggcccagagggcaggcatgctctcagtcattagcgcttcccggaggaggtgtaggagggaagcaggggtaaaggatactcagggagaaggacaggctagagggaggctggagaacgtgattgttaatgctcattcacaggtatttctttgttgtagaagggtggttggtggttaggggaggtgtgtgccttttatgtttctgattttcttttctttttttgagacagagttttgctctgttgcccaagctggagtgcagtggcgtgatcttggctcaccacaatctccgcctcccaggttcaagcaattctcgtgcctcagccacccaagtagctgggattacatttgtatttttggtagagatggggtttcaccatcttggccaggctggtctccaactcctggcctcaagtgatccacctgccctgggctcccaaagtgctgggattacaggcatgagccactgtgcctgacccacttttctgattttcaatacctcctccatagagcagtaaaaaaagaataagaagagctgtttttttttcttggctctgtcactgtgattggaatcttctttcaggacctcagtttctctagttgtaaaatggggcaggaggtggtcaggataattaatctctggctcccttccagctttaataattattttccaatttctgtactcacaccctcccctgtaatcaggtaaatattccggattggattgttgaccttcgccatgagttgacccacaagaaaatgccccatataaatgactgccgcagaggtgagtcctcagaggttatacctatcacagttaagcccaggggcctgggcttggtggcgctgagggtagagggataggcaggagggtctccacctggagtcaaggctgggactagggtgaaagaagtgaggcctcgccttgggcacaacatttaaagtggggagaagtcaaaagttccataatcaagataaataacatattaatgtggaaaaattcatgataaacataatatcaaaactttaagtaaaacgggattagtattactgatttctccttttgtttcagcttccaacatggcttggcatattttgataccttgactacagaggtttttttgcctgcccttaagttgttttttgtttgtttgtttgttttgagacgagtctcaccctgttgcccaggctggagtgcagtggcacgaccttggctcactgcaacctccacctctcgagttcaagtgattttcctgcctcagcctcttgagtagctgggtctataggcacatgctactatgtctgattaactttttttttttttttttttgagacagagtctcactctgtcacccaggctggagtgcagtggcgcaatctcagttcactgcaacctccacctcctgggttcaagtgattctcctgtctccacctcctgagtagctgggattacaggcacgcgcctccatgcctggctaattttttttttttgtatttttagtagcgatggggtttcatcatgttggtcaggctagtctcgaactcctgacctcatgatctgcccgcctcagcctcccaaagtgctaggattacaggcatgagccactgcacctggctgtatttttttagtagagctggggcttcatcatgttgcacaggctggtctcaaactcctgacctcaagtgacccgctcaccttggcctcccaaagtgctgggattataggcgtgaaccacagtgcccggccactccccttaaatgttgtttctcaggtagtgcctcattagtctcacatacctctccatagttgaggtggggaggttgccaggcatgagccatcagcagtgtcatgaacccaagggttccttggacatccaccccatcccgattaagaatcctggatttagcctcactctttgtgatgggaaaacagatctagaaaaggggagacttggccaaggccatgtaactagctaatggggctgattcctacttctgccacttactagccccttaactgtttttggcatctcgtctctaagtccaataataggtttttttttctagaaaaagtgctggtaagcaggataaagcaaagaacagggggataacccagagtgaaagaggctgcttctggatatttgagatttgaaccttggagccaagccttttcctggggccttcctataatacccacaagatgaggctggaggcctgctagctgcctgcctgatcctgtggcactgcctgccttcccccctctaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatggtaggtgttttggagggcagaaagcggcccatgagcccagaaggctcaggcttagggttaacgctgtttatttccctggctcagcatttcctctggggctgtggtgaatcttagcttaaaaaattactgtcacaaaccatcctcctggctagtttccatagtataatggctgtcacatttgcctcacaaaccatcttgagccctgtgaagtagttggggaaggaattctagttcctcaattacaactcaagaaatgaggtgagagaggctcagaatcccatcaggagaaggggtctgggctggcagtcctatctgtctccccattctgttttcagaaagagcccgagaactgctggtatcatacgaagaggagcagtttacggtaagaaagtgccctggacttggtgtgctctcatctgccccagccatttcttccctcttgccagctacctgagagaagtcttgagaaggaatttgaaagaaaagtgacaaagcgtgagggaacttctcggaaagagagaggggggaactaggaaggagacaagaggagcagagtccaattggctgatcctccacaccgatggaagggaacagatgatgaagtttgcggataatctgccccactgggtggtagggaacaactgggaatgggtagttgcgcagccctgcaattccgcagctgaccagtagatggggcccaagagcttccctaaatcaggtgagctggaggggtgctgtttttagggaggtcactcagaaaccatttagctcagcccttccttttcacagattaagaaattgaagccatggatgagtgaagggacaggcccaaagtcacatatacagttaatgatagaaccaggattagtacctggatctcccagttatctttcttctgtaactcattgcctctcctcatctctggccctttggcctaagagtctctatctccagccaaattcccccattgaacatctcagtatttacccacaggaaattcagttggaggaggaagggagggagaaggaggaggaagtctcacatttgagagtcaggctatttttagttgcaaggccagtaggggagttgtgggcccccccctgcatgccctgccctgtcccctgcagggcagtgctgagaggtcctatgggaagggatcctggaggggtggaggtgggttgcttggctgaaccagccttctgatgggaccctctttgctggcaggtgctggagaaatttaggtatttacctaaggccattaaggcgtggaataacccgtccccacgtgtagaatgtgtcctggcagagctcaagggcgttacatgcgagaacaggtgtgtaactaggtaaccgggagctgcgtattctctaggatagagggtagcagcctcattgaaatcggtttccctatcctagcttgccaacctctgctgtacaaaatcccagggataatcctgatcccctccacagtgaccctacatttggcagaactgtctgccctcaaccctgccaacttccaggtgggggttgcctatactagaatggccagaggcaggaatgcccactatcatccatctgctggccagctgctttcctgtctgtcgggtggcatgtggagctcttgacaactaggaaaatcccttgataattaccacctcactcactgcctagcccttgtctaagtttgaggtaaaagatatatgtatggtgggcactgctagtcttgtcttgttttttttttattttttatttattttttttgagaaagtgtcttgctctgttacccaggctggagtgcagtggcgcagtctcggctcactgcaacctccacctcccgggttcaagtgattctcatgcctcagccaccagagtagctgggactacagacgtgagccaccacacctggctagtttttgtattttcagtggagacagagtttcaccatgttggcgaggctggtctcaaactcctggcctcaaatgacctgcccttctggacctccgaaagtgctgggattataggcatgagccactgtgcctggccttttctctttttttacgatagggtcttgctctgtcacccaggctggagtgcagtggtgcgaacatagttaactacagcctcaacctcgcacactcaagaaatcctcccacctcagcctcctaagtagctaggaccaacaggcatgcactaccatgtctggctaattttataattttttgtagagatggggtctcaccatgttgcccaggctggtttcaagttttgggattcaagagattgtcctgccttggcctcccaaagtgctgggatcacaggtataagccactgcagccggcctggtcttttttttttttttttttttttttttttttttttttttgagacagagtttcgctattgcccacgctgcagtgcagtggcacgatcttggctcactgcaacctctgcctcccgagttcaagggattctcctgcctcagcctccccgagaagctgggactacaggcacgtaccaccacacctggctaatttttgtatttttagtagagacggggttttgccatgttggccaggctggtctggaactcttgacctcaggtgatccacctgccttggcctcccaaagtgctgggattacagatgtgagccaccacgcccgtcctggtgttttcttttgaactgccattggagagtattagcatcccttggatagtcatggttaggggaatagaggcgggaccttctcagggtctggctcctagagactaagttccttgtctctcaagtatggctgtgagcctttgtttccaaaacaaagtgctcagctcagtccagagcaggcgcatagtatgtctacccattcttctttcctccctagctcttgggggctttctacctaaattcagctggaagggctttgggggactttccgctaagaacgtgtggaggcaatgctaaacctcagctagagagaagttggagagtttaggtaggtggtgtaggtagcagagtaaccctgggtgagaactgcagtgtaggctgggattgcccctggagtcttctcttcatgtccaggatactcgttccaaaagtattttatcagtgtttgcccagcctaggtttcttggctctacccttcagcaaaagggttggtggtggcttcattagcagctgggaaaactatgcccctaacacagtagtgtctgcctggtaatgctggagagagggatctaagtatgtcaattttccaggcattaggacaacttgggagctcttttttccacgtctaggcttggtcagttaggagaatgtctatatctgtttagtgttgctataaaggaatacctgaggctgggtaattttgaagaaaagaggtttgtttgtctcatgcttctgtatcctgtatgagaagcatggtgccagcatctgcttctggttagagcttcaggctgcttcttcccctcatggcagaaggcaaaggggagtccacatgtacagatatcaaatggcaaggtggagggggagatgtcaggctcttttttaacaaccagctcttgcggaaactaatagaacaagaacttaatactgtgggaacagcaccaagtcattcatgagggatccgacccaatgacccaaaccccttctacaggcaccaaggtcaacattggggatcaaatttcaacataagatttggaggggacaaacatccaaactgtagcagaaagcctcttgggaagccactaactctggaggaatcagcttgctgttgctggtgtaggtttgagctattaacccatttatgccggaggttgcaatttctttcttttttttttttttttttttgaaaaatcagaccttggtgaagaccttgagcagtaggatataaataactcccacaagcttagcgttccaataatggaacactcggcataaatgggttaatagatagggatgagagattacccctatagcctactcctgcaacccctctaactttgttctgggtttttagaacccctagtaataaggcctatggaccatatttggtctagcagttgggtccccaaggtttctacttctaggatctaaaagaaggtagccagggagaagagaaggggtagggtactgaagaatggtcaagataaacagactgcaagaactgagtctaaaagcccttgaccccatgatcccaggcatttatttccttctgtggatgtggaactttttcctgtctgtgtgttgaagtgtattcagacactactgctctcgttatgggccatagatcagcattagtgcttggtaagcacttgttcaaaacccactgatcccagcctctaaccagcccctgcctgaggaggctgaagcctaagatccaattgtcaactcccttcctccccactcctacccacccaccacccctcctccctatgctgcttcagccacttgagccagaggcattagctgctttggaggtgggtggaggagtaggagagggtcttctgccagcatcactttgctaaactagtgtcctcttgttccagggaggctgtgctggatgcttttctggatgatggcttccttgtccccacatttgaacagttggcagctttgcagatagaatatgaaggtagggttctgggggctcactgcacccttagggttctgattcctgggtggaaacagctggggtgggctggggggccctgggttggggtgtgaaggctgtttcctgccattccatggcctctgaaagtccctcagccttcctggctgagcagaacaggtagccccactgacagttgtggggctgcccttaagtgctctggaatggggtggggtgggatggggtggggtcggggagtcttaatgacattattgtgccatgttcgttgtgatttagctgctagctagagagctagaacagcagaattggaggggccttgtgaggtcatctagtccaacatcctcatgttacagatggtcagactgaggtccagagaggggaaggtactgacccaaagtcacacagtgagttattgacaaagctgaagctagaaccagatctctgttttgtttatactttattttgagtcagttgttggttgccagatactaactggtttctctctccccactgttctgctctcctctttcctttgttctgcggtggcaactctgttgttggtggggggcttggctcatgcgcgcgcacacattctcttgctctcactctcacttcctttctcttgctgtctcttgctctctctttcgtgctctcctgctctctctctcctattgcccccccaaatgggtgtcccttacaaaccagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggtgagggagactagccctagccctagggcctaaggcagcccaggcaggagcctctgccactgtcctcagctctctgctaagaagcaccaggcaaacacctcccgtgttaaaggtttaggtttgcccaagagggccccacggcagcagtggacaaatctcccttttccttttcttctcagagccaactaaactgggctggggcaaagtgccctgaattctttgagcagttgggaggtataggtggggagtctggggggatggggagggacagagccaaactttctgaggtgaaatgttgggtggggggctcactgcttccttctccttagatcctctcttctctctcaggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatgtaagtctcttgaattccatccggtaagagggtgaggcccttcaagcctcagggccacactgccctagaatgactgagttagaagggccctttggggacagtctagcccagtctcactcccactgacagatgggacaactgagtccagagaggggaggggtagggttttcttacctaagatcatacagcttaagacctgactgaactgagtccagtgtgggaatggataagacaatccccctagagtgcttagcacagtggcctgcacagagtaagtgcacaataaatggtagctgctgtttattattgaacccaggtcttctgactccaagcccagtgctgtttcctctattatctttccaaagtatacctctgatagttgcttagcaaccttcagttgctccctattgccttcctgttaagtctaggcttcttagcctgacattcaaagatctttctgattctggcccaacttaccatggtagccatacctcctgtgagtctcctttaccctatccaccctgggttctatggtcaaactgaatattgcactggtaaatacctgtggttgtctccctttccttttctctgtcatttcctgaccctgagccacttccctcataatcatggaagcctttagcgcctgattcccttcttgctttcttgagcaatatctgtttcatttggatgactcatctgacactctacagctcctcaactccagtgactttcattctccactacactcagcaacccatttccatcattcggagctattccacctctgaaagctcacatcccagcatcccactcggtgaccaccacttctcgtccttctagttctcacccttgcatcccatgacatctgctctttgcctgcatccagatctccatccctccatttcctgcatcccttgaccttgcttcctctctatcctgtctgtggttgctcagttcggccactcatcatcagcaccttcagctttgcccatcctttggccatatctgacttgcaaacccctgagctggaattgatcctccccattctgcttcccctgctcctcagcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctgaaacccaaatctgtctagccctggcccctcccccaagattcagcctcctgtactcgactacatgtcagacatctccccttggatggcccacaggcaccttactgtgaccaaaagagaattggtcgtctcagtccccatctcaactctaaagtgatcttcctcctctgttccctatctcacttggtggcggcaccatctaccctgtcctgttgactctcgaatacttcccaaatctgaggttttgtgttgccgtgtctacttcccttagtgtctccttccctctatcagactaagcttttcaagggcaaggactctacatcagctgtccgtgccctagcacaccacacaagtctaggcaccaaacaggcctcagtaaatgtcgttgaattgaaccgtgctctgctctctcattcccagcagtgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaattaagtgtcaggcatggtgctgtgtttttttgtagaggttaacttcatttactttgacacagcagtcttgggaggtggaagtattatatattataccctatttgacagataagacattgaggctctaaggagtgatgggacttatctaatagctacacatttgttgatggtgggacagggatcttggcccaggtggtgtgagcccaaagtctaccttcatcccatcagcctgaatctgtgaccttctcagtcctgagctatgaccagacatactcgaggaagggggtgtattttaagattcgcatcacccccgcaccttagtggtcagactaatggttcgagatagcaggtgggtaatcataaacagggctgataaggcattttgccagtatcaagtgtctgggaatatttattattaatcacactaatggaccaccatgagaggacaaagtttctctctggcttttcatctgattagagctggaagcttttcaagcactttctccagccagccaatatcaatttaatttgagccactatcgtcttggaatatgaaattgcctccatagacaggatctccagtgaagtcatcagccccccagccctgcccccactgaccagtcaccctgcatatgtgaccagtctgcatgtgcccagagagaaaacagcctgctgagctcatggcccgtctgtgaaccatccgcatccatctgtgactgggtgcctgttaggtgccaggctctatgagaggctctgtgaggggtgctcaccctcctctcccctcgagctccccttcccagcagctctgtatctgttggtggttttgctgttggcgccgtcttttgtgtgcacagtgtcatcatctttaactctgcctgacccctgccatcagtcaccaagccctgctctctgtctgtctgtgtgtccttcacagcttcactccctcccatctccactgccagtgccccaggtcagccctccccgactctggcctcaactgtcggaacaggctcctccctggtctccctgcctccaggctgcctgtccaggccagcctccacatggtcacttggtgatcttcagaaacatagccttcatgtgtactcagaattggcaggtgaaccctcacacacacaccaatgcacacacttaccttcccagccctctcttcctcccacggctcctcagcacaggccgtgccctctagctgggctactcactgcacgcagcagcaccgtgtgcttgctcttgtctctgggcttcccgggccctacctcctgcacaaagccctcccttggtctttcctgccctcctcgtgctctctgtctccctcagccccgcagtgcctgcagtaggttcgcagtgctcatctggcctccctcccacatcctgctttgtcttgtcagccgctgctttttttttcttttcctccattccaggctgggctgtagctgctcccataaagggatcacagtttgtgttccacgcagaaggagcacagaacacttccaggcatatccttggagctcaagacaggttgctcagctaggccagagaagagagggatctgttcatttccagccctgcaggcctgttggctgttttgtgcatttatgtagcttttaagtgcagactaatagctatcatttattgcatgcccactatgtgccaggcactgtgccaggcattctatgtgagctttcttatttactcctcccaacaatcctatacattaggtatcattattgtcctcattttacctgagaatggaagtgaggcacagagatgaaccacagagtttgttctgggtccatggtcctgttgtttctatgttctgtctgctctactacactgcctttcagaggcaggtctggaagttcagagaccaagttcaaaccctggagtgttggggtatgaagtggcttgagattttgaatctttcctaccccatccctccctttgctcagcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcaggtaagaactactttgtccccacatggacttcttttctctttggctggctcttgaggcttccttctaccctaggaagagatggaaagtagcaggaggtagccaatgtgaggcaagcctggaaggcagcctggtgcatagatgacagctggcttctcccacctcttaggatggagcctgtgagtgccagggaccactgtcaggctgctggctacctcacataagagcacattctgagaggatgacatgggtgtgagccctgggcagtaacatagaggcagaagatagcaagaagtagggagtgtgtacatatatggttctgcacgtgtttttcacttgcagtgagacagtgctttctgtgtatgtgtgtgtgtgccttgaggctggctggtggtgagacaagattttgatgtgtgtattagaaagaaggaacctaggagaccgggcgtggtggctcatgcctgtaatcccagcactttgggaggccgaggcgggcggatcacgaggtcaggagatcgagaccatcctggctaacatggtgaaaccgtgtctctactaaaaatacaaaaaaaaaattagctgggcgtggtggcgggcgcctgtagtcccagctactcgggaggctgaggcaggagaatggcgtgaacctgggaggtggagcttgcagtgagccgagatcgcgccactgcacttcagcctgggtgacagagcgagactccgtctcaaaaaaaaaaaaaaagaaagaaagaaagaaagaaggaacctagggcattaagtcagagaaacaggaagtgagatcacaagacagaataaggaatgctgtgatttttaggtgagcacacaaattagtgaggccaaagctaggaagaggctgcagggagggttagtgatagggatctgctcttccttttgagtacccttgcttaggttaatgaacaggaacctcggaggccggaacacacagaagggatgacagaacagtgtggtgtctgtgtgctgaagcctggggagggagggagaacagctgggcctgcgtgatgtggggtgtgcagtggcagagagtgagaggggaggcagtgaatgagtttatagagaaagatactatggcctttgtttgtccttgtatggacagggtggaagggctggaacataaaacataaagtctgtctctctgtgtgtgtgtgtatgggcatgttcctgtacctgctggtcaaaccatagcccagtgacaaataacttagggcaaggagggctgtgttgggggttctttgtaaatattgaaagggaggggcattgacataagcagaatttgtgtgtgtgtgtgtgtgtgtgtgtgtgtgtgtgtgtgtgtgtataggaaaaagggaaaagtaggggcagttaagtcatggccaagcaggctgtcgtacagctttgtgaagaggaggcagggttgctgaaatccatgagggctaataggtaatctgtgtgagagagaagtgatagcattgaggttggtggctatggaggggtagtgggaacaggcagtgagatatagccatccagagatggcctgtatgttcacgccgtcactggggacatgtacaagggtatcaggctaaagaggcaggggtagtgatgtagacagcattggcgatattagtgatgacagagagatgatcgggtcagtgacagagcctatgtaggtagtggcccctgtgcacgaaggtgtctctgtatcatggagtaatgcaggacattaagacaggcacaacttccagtaagagagccaggggagggggatggacaagtagaggaacagtccttcctgaggagctctgggttacataaaaagctggtccagggttgacacattatagaatgccaggggcattatgacagggagaattctttgagtaccagggagatgcagaaggccagaaatggaatctacatggaatgcaccagtgaaggcttcatttgaaaacactgaatgcacttgtggaaggatggggagggacatttaatataatactgtgtggtaggcgtctcagtgatacgacagagagggatgggggatgtccggcatccccattctaaagtggagcatctgtatatggggggatgtgagttgtgaatgtggaaagtctagaacattaactctttccctttctcctttgccattgctccttatgtgtgtacacatgtgtggggaggtagggacaggaagattgctggttgtatgccagtgaatgaggggtgtgggaggcagggagtgaacaggacagtcactgagtgaaggacttgtgtatgtgtgcttctgtatacatatttgggtggctgtgaggggtgggatgtgtggtgagacagccgttccctagaaaaggggtgtaccttgtgcatcttggggcaagaactgcagggggcaggggaacatactatctcagggagtccaccctgagttgggcatgggggtgtgtgtgtatctctgcattaagaaaatatgtggtattcaaacaggcaggggagtgtgtgtgtagatttgtaggaaatctaggtcattcagctactctgaggtactggtgggtttggggtttgagggggaggtgctttgggaattctgggacatccagaccctccatgatgtgtccctgtgtgtgtgtctacagacagggaaataggggtgaagatgaaaagttgaagcagtgatacagcctggtcagaagttgttgtttgtgtccgtgtggaacatgcctggggaagtaggaaaagagcaaagagggacaaaaatgtctgtagttgtatacttgtatatgtaagcacatagagggggagaaggaccataaagaatgtgtggtgaagcactctggtggagaggggctcatgagaagtgataccgagagcagtgaagctggagatcctgagagagcccacctgtgctaagtggggtgggtggatggacagggtgagcaggcctgtgcaccagtcggagaaccagctcatcagcccagtcttgccacttccctttgctccacagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgagtgagtgcccatggcaacaggatttctcaccccctttctctgccacctgtgggagggagagaagacaaggtgaggtgggtgggggaggtagctgtccccagtcagggcctaaatgagtgaagtgtaagccccagtccctggctgggcccttgccagctctccctgtccctagtgtggggagccagtgaagtagccacacacagctgggcttggcatccctctcagattgcattcagtttgtgcttatggatggacgtgtgtgtgtgtgtgtgtgtgtgtgtgtgtgtgcaggcacacacacacattttgggaggagaagggtccatagctttcagcagattctctaactggtccaccactcctaaaaagtcaaaaatagatgctctcatccagctttttcacgttactgaggagaaaactgaggcccagaaaggggaagggatttgtctaatggtgcatagagtaatcagtaggcctccccacactgtccaggcaccttggtagcaaggcctgcacggggcttcatgctctccctcaaaactcgcctctggatcacaggcgtgggagcccttgggtcaccagggagccaggaaccaagcagcccttgctgaggggctatgctagtaacacaaaggagcccatccaaagggcctgtacattccagaatgctgggccattctgaccagataatcctgtgagtactagagaggaacccctgcgggcccctgaaactaagtctttccctttgctgcctgcccactccctgggagatgaacccctcttcatctgggcattctgggaaagggctatagaatccaggggccccagaagcaggccagacccaaggcaatgccatggactctgtccaaggccatgggccagcaggcctcttggagaagagaggtggcagctggggaagccaggagatctgtagttgggagtgggattcacatgtctgagagaggtgcccttacccctccttcccaaccagcctggccctgggtaaggatggcttattgagtaccatggatagcaagggtgaagtgtgggcagctggagctgttcagtcaagaaggaagctgattcagcccagctcccacacccactgtagtagggacgtttcctttgctgtggaggggcatgcccacccctgcttcttgtctcagctccacccctgacttggctatgtggccttgggaaagtccattcccatctctgggcctcagttaacttgtctgtaagattgtgggtgatgggaggtggtggaactagattatccgtaagggttctttcagctgcagtagtgtaaccatggatctgcctgagggtagggtgatggctttgctctcagctgtcaccctcacccagctggaaggaccttgacttgcgggaagcaggggaagcaagagtgttatgagcagggccagggagaaggagggcagagccaccctccctaaagcaatcttgcaatcgtgggcctagtcttatagcccaagcctggccttgggccccttaaccaggtgttgggtgtgggagggatccaggcccccaagctctaaggccttgaaaggatgtcctgttaaggcagctactttcaatgtcttgggagtcaggttatgtggggccccctcccctacctcaacccaaacagctctgctttaatctggtttatctactagggctctgcataaaacttcatttgaaaagttcttgcctccttccctcccttcctcaactgaggagagggccaagtcaaccctggggcccacacgaagtcgtttctcggatttgctccagtctctttgtaaagccaggcaggagagtgggcccatcccacagatacacacatgtcaagcactcttggcccctccagagcctaaagctgcctccttccctgactgacctcccactctctcctcagcaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactg

SEQ ID NO: 5705 - DNA, 22173 bp, human; identical to SEQ ID NO: 5704

SEQ ID NO: 5706 - DNA, 22192 bp, human
gcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtaaggtggcgggttcggcccttttgcctgcgtgctggtggcgctgcacctcttcctttgtcgagtttctataaggccctgttctccagtcttcccctaagtcgcctaaagttgtccctctcccaaatgcctgggggaacgcggcagccatctcttgcgctaatcccgttagcggaatggaaagtaaggggttgtgcctcaacaattctcttgttatatctgtgaggtttacccattacctccaaaaagtgactttctcccaacttggagaggatgccggagggactagtgaggcctgagccagggcttaaggagtagattagtaccctagggtagatttccgattccaatggggaggaagtcttgcctgcaagacagtgtttgagtggggcgcctcagtccagttggtaagattgagttgggagccgacttacaagggataaggggctcctctagctcaatgagttgatttgggggtgaaagaaaggggtgtgtccacacaactgttgatggacagtctaccagttaggtgtcctgtatacggcctagtcagctcctcatgccctgtatactgttggatcccacagacattaccgtgtctcctcccaccttcttgttttgtgtctgttcatgctctcttgaaccagaatatgatgggtgtagcctgcaacaacctaggttctgaggtggagggtggaccagtgtaagggctctttatgatggtgctggactgtgaccctttaggtcaggcaacgaactccctctggcagtggcttctactgctgacctgatacgctgtaagctcttggatgtaactggtggcttgggcactgatgaacttagactgctctatggcatggcattggtcaggtaagacctgcatggggtaggggtggaggttggctttggggactggaggcaggggaggcatgtgataagcaaaacttggcttcaggtgttacctgaagcaaaaccctgcgtgtacctcactgtggatcagcctgtgattattgcttgacttatcagcttttggtaccctcgtcaacgcattcctctttttcttcctttttcctgaaagccttctcttccatttttctttctatcttggaatgtggaggaagggattcagaccaggtgatctctgtgggtctcttggtggtctgatattttttcttacctttgaattcctcacccagaggaacttgtctgaatggctcagggtcctcgcctgtgatttaatgtggactttccaaccctgtccctgtctattcctagcactacccttttccccttctctccctcatgaacactgaaagattgctgagttatggaagtggagacatgggctgggaattcctgacttacaaagtgactcataatggttctagctgtatacacgtcggaaaaaaaggttgctactgagttttcatatctgtcaaagtctttgcttatctatttccccttgtctgccttgagatcctccctttctcttcttattttctccattggttagctgtgctccccattatctgatgtagtcctttgcagcatttataacatattatgttctagcctaatatgttacattgtatcattattatttatcctagaccgaactgttcaaggctagagcagtgtcttattcatctgtatggcttcattatagggcagactctcattaaatgttggaatggatggaactgtccctgctctggctgacacaccagctgtaggaataggacaggacagtcggtggaaaagtggaaatgcagggtttcagtaactcagcaaagtgtttggaataaaatggttccttgggctgtgccacttatttctccctcaactccaggtttgtgaatcttatctcagagaggaagacaaagtttgccaaggtccccctcaagtgtctggctcaagaggtgcgtatgattcagtgaacttgctcaattctgtctccaagagggctcaccaaatggggcatggggtattgtgggcacacagtcagactagctcatcccatcactaccagccaagcccagcaagaatcccagagcctcagcttccagcctgaaggaggcacagttgctcccttgctctcatatgactggtatctcagagggcttggcctgcccagcttgctgggaggagcccaaatgtagcactgggtggggacaggaaagaggtgacagtcacagcacctgccctcatggagctgacagtctgagagaggagacagctcagccactatgagtcactttgtaaatcaggaattcccatcccatgtctctacttctgtaactcagacattcctaccctgaggagtatgtgaactgtgtagaggcccagagggcaggcatgctctcagtcattagcgcttcccggaggaggtgtaggagggaagcaggggtaaaggatactcagggagaaggacaggctagagggaggctggagaacgtgattgttaatgctcattcacaggtatttctttgttgtagaagggtggttggtggttaggggaggtgtgtgccttttatgtttctgattttcttttctttttttgagacagagttttgctctgttgcccaagctggagtgcagtggcgtgatcttggctcaccacaatctccgcctcccaggttcaagcaattctcgtgcctcagccacccaagtagctgggattacatttgtatttttggtagagatggggtttcaccatcttggccaggctggtctccaactcctggcctcaagtgatccacctgccctgggctcccaaagtgctgggattacaggcatgagccactgtgcctgacccacttttctgattttcaatacctcctccatagagcagtaaaaaaagaataagaagagctgtttttttttcttggctctgtcactgtgattggaatcttctttcaggacctcagtttctctagttgtaaaatggggcaggaggtggtcaggataattaatctctggctcccttccagctttaataattattttccaatttctgtactcacaccctcccctgtaatcaggtaaatattccggattggattgttgaccttcgccatgagttgacccacaagaaaatgccccatataaatgactgccgcagaggtgagtcctcagaggttatacctatcacagttaagcccaggggcctgggcttggtggcgctgagggtagagggataggcaggagggtctccacctggagtcaaggctgggactagggtgaaagaagtgaggcctcgccttgggcacaacatttaaagtggggagaagtcaaaagttccataatcaagataaataacatattaatgtggaaaaattcatgataaacataatatcaaaactttaagtaaaacgggattagtattactgatttctccttttgtttcagcttccaacatggcttggcatattttgataccttgactacagaggtttttttgcctgcccttaagttgttttttgtttgtttgtttgttttgagacgagtctcaccctgttgcccaggctggagtgcagtggcacgaccttggctcactgcaacctccacctctcgagttcaagtgattttcctgcctcagcctcttgagtagctgggtctataggcacatgctactatgtctgattaactttttttttttttttttttgagacagagtctcactctgtcacccaggctggagtgcagtggcgcaatctcagttcactgcaacctccacctcctgggttcaagtgattctcctgtctccacctcctgagtagctgggattacaggcacgcgcctccatgcctggctaattttttttttttgtatttttagtagcgatggggtttcatcatgttggtcaggctagtctcgaactcctgacctcatgatctgcccgcctcagcctcccaaagtgctaggattacaggcatgagccactgcacctggctgtatttttttagtagagctggggcttcatcatgttgcacaggctggtctcaaactcctgacctcaagtgacccgctcaccttggcctcccaaagtgctgggattataggcgtgaaccacagtgcccggccactccccttaaatgttgtttctcaggtagtgcctcattagtctcacatacctctccatagttgaggtggggaggttgccaggcatgagccatcagcagtgtcatgaacccaagggttccttggacatccaccccatcccgattaagaatcctggatttagcctcactctttgtgatgggaaaacagatctagaaaaggggagacttggccaaggccatgtaactagctaatggggctgattcctacttctgccacttactagccccttaactgtttttggcatctcgtctctaagtccaataataggtttttttttctagaaaaagtgctggtaagcaggataaagcaaagaacagggggataacccagagtgaaagaggctgcttctggatatttgagatttgaaccttggagccaagccttttcctggggccttcctataatacccacaagatgaggctggaggcctgctagctgcctgcctgatcctgtggcactgcctgccttcccccctctaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatggtaggtgttttggagggcagaaagcggcccatgagcccagaaggctcaggcttagggttaacgctgtttatttccctggctcagcatttcctctggggctgtggtgaatcttagcttaaaaaattactgtcacaaaccatcctcctggctagtttccatagtataatggctgtcacatttgcctcacaaaccatcttgagccctgtgaagtagttggggaaggaattctagttcctcaattacaactcaagaaatgaggtgagagaggctcagaatcccatcaggagaaggggtctgggctggcagtcctatctgtctccccattctgttttcagaaagagcccgagaactgctggtatcatacgaagaggagcagtttacggtaagaaagtgccctggacttggtgtgctctcatctgccccagccatttcttccctcttgccagctacctgagagaagtcttgagaaggaatttgaaagaaaagtgacaaagcgtgagggaacttctcggaaagagagaggggggaactaggaaggagacaagaggagcagagtccaattggctgatcctccacaccgatggaagggaacagatgatgaagtttgcggataatctgccccactgggtggtagggaacaactgggaatgggtagttgcgcagccctgcaattccgcagctgaccagtagatggggcccaagagcttccctaaatcaggtgagctggaggggtgctgtttttagggaggtcactcagaaaccatttagctcagcccttccttttcacagattaagaaattgaagccatggatgagtgaagggacaggcccaaagtcacatatacagttaatgatagaaccaggattagtacctggatctcccagttatctttcttctgtaactcattgcctctcctcatctctggccctttggcctaagagtctctatctccagccaaattcccccattgaacatctcagtatttacccacaggaaattcagttggaggaggaagggagggagaaggaggaggaagtctcacatttgagagtcaggctatttttagttgcaaggccagtaggggagttgtgggcccccccctgcatgccctgccctgtcccctgcagggcagtgctgagaggtcctatgggaagggatcctggaggggtggaggtgggttgcttggctgaaccagccttctgatgggaccctctttgctggcaggtgctggagaaatttaggtatttacctaaggccattaaggcgtggaataacccgtccccacgtgtagaatgtgtcctggcagagctcaagggcgttacatgcgagaacaggtgtgtaactaggtaaccgggagctgcgtattctctaggatagagggtagcagcctcattgaaatcggtttccctatcctagcttgccaacctctgctgtacaaaatcccagggataatcctgatcccctccacagtgaccctacatttggcagaactgtctgccctcaaccctgccaacttccaggtgggggttgcctatactagaatggccagaggcaggaatgcccactatcatccatctgctggccagctgctttcctgtctgtcgggtggcatgtggagctcttgacaactaggaaaatcccttgataattaccacctcactcactgcctagcccttgtctaagtttgaggtaaaagatatatgtatggtgggcactgctagtcttgtcttgttttttttttattttttatttattttttttgagaaagtgtcttgctctgttacccaggctggagtgcagtggcgcagtctcggctcactgcaacctccacctcccgggttcaagtgattctcatgcctcagccaccagagtagctgggactacagacgtgagccaccacacctggctagtttttgtattttcagtggagacagagtttcaccatgttggcgaggctggtctcaaactcctggcctcaaatgacctgcccttctggacctccgaaagtgctgggattataggcatgagccactgtgcctggccttttctctttttttacgatagggtcttgctctgtcacccaggctggagtgcagtggtgcgaacatagttaactacagcctcaacctcgcacactcaagaaatcctcccacctcagcctcctaagtagctaggaccaacaggcatgcactaccatgtctggctaattttataattttttgtagagatggggtctcaccatgttgcccaggctggtttcaagttttgggattcaagagattgtcctgccttggcctcccaaagtgctgggatcacaggtataagccactgcagccggcctggtcttttttttttttttttttttttttttttttttttttttgagacagagtttcgctattgcccacgctgcagtgcagtggcacgatcttggctcactgcaacctctgcctcccgagttcaagggattctcctgcctcagcctccccgagaagctgggactacaggcacgtaccaccacacctggctaatttttgtatttttagtagagacggggttttgccatgttggccaggctggtctggaactcttgacctcaggtgatccacctgccttggcctcccaaagtgctgggattacagatgtgagccaccacgcccgtcctggtgttttcttttgaactgccattggagagtattagcatcccttggatagtcatggttaggggaatagaggcgggaccttctcagggtctggctcctagagactaagttccttgtctctcaagtatggctgtgagcctttgtttccaaaacaaagtgctcagctcagtccagagcaggcgcatagtatgtctacccattcttctttcctccctagctcttgggggctttctacctaaattcagctggaagggctttgggggactttccgctaagaacgtgtggaggcaatgctaaacctcagctagagagaagttggagagtttaggtaggtggtgtaggtagcagagtaaccctgggtgagaactgcagtgtaggctgggattgcccctggagtcttctcttcatgtccaggatactcgttccaaaagtattttatcagtgtttgcccagcctaggtttcttggctctacccttcagcaaaagggttggtggtggcttcattagcagctgggaaaactatgcccctaacacagtagtgtctgcctggtaatgctggagagagggatctaagtatgtcaattttccaggcattaggacaacttgggagctcttttttccacgtctaggcttggtcagttaggagaatgtctatatctgtttagtgttgctataaaggaatacctgaggctgggtaattttgaagaaaagaggtttgtttgtctcatgcttctgtatcctgtatgagaagcatggtgccagcatctgcttctggttagagcttcaggctgcttcttcccctcatggcagaaggcaaaggggagtccacatgtacagatatcaaatggcaaggtggagggggagatgtcaggctcttttttaacaaccagctcttgcggaaactaatagaacaagaacttaatactgtgggaacagcaccaagtcattcatgagggatccgacccaatgacccaaaccccttctacaggcaccaaggtcaacattggggatcaaatttcaacataagatttggaggggacaaacatccaaactgtagcagaaagcctcttgggaagccactaactctggaggaatcagcttgctgttgctggtgtaggtttgagctattaacccatttatgccggaggttgcaatttctttcttttttttttttttttttttgaaaaatcagaccttggtgaagaccttgagcagtaggatataaataactcccacaagcttagcgttccaataatggaacactcggcataaatgggttaatagatagggatgagagattacccctatagcctactcctgcaacccctctaactttgttctgggtttttagaacccctagtaataaggcctatggaccatatttggtctagcagttgggtccccaaggtttctacttctaggatctaaaagaaggtagccagggagaagagaaggggtagggtactgaagaatggtcaagataaacagactgcaagaactgagtctaaaagcccttgaccccatgatcccaggcatttatttccttctgtggatgtggaactttttcctgtctgtgtgttgaagtgtattcagacactactgctctcgttatgggccatagatcagcattagtgcttggtaagcacttgttcaaaacccactgatcccagcctctaaccagcccctgcctgaggaggctgaagcctaagatccaattgtcaactcccttcctccccactcctacccacccaccacccctcctccctatgctgcttcagccacttgagccagaggcattagctgctttggaggtgggtggaggagtaggagagggtcttctgccagcatcactttgctaaactagtgtcctcttgttccagggaggctgtgctggatgcttttctggatgatggcttccttgtccccacatttgaacagttggcagctttgcagatagaatatgaaggtagggttctgggggctcactgcacccttagggttctgattcctgggtggaaacagctggggtgggctggggggccctgggttggggtgtgaaggctgtttcctgccattccatggcctctgaaagtccctcagccttcctggctgagcagaacaggtagccccactgacagttgtggggctgcccttaagtgctctggaatggggtggggtgggatggggtggggtcggggagtcttaatgacattattgtgccatgttcgttgtgatttagctgctagctagagagctagaacagcagaattggaggggccttgtgaggtcatctagtccaacatcctcatgttacagatggtcagactgaggtccagagaggggaaggtactgacccaaagtcacacagtgagttattgacaaagctgaagctagaaccagatctctgttttgtttatactttattttgagtcagttgttggttgccagatactaactggtttctctctccccactgttctgctctcctctttcctttgttctgcggtggcaactctgttgttggtggggggcttggctcatgcgcgcgcacacattctcttgctctcactctcacttcctttctcttgctgtctcttgctctctctttcgtgctctcctgctctctctctcctattgcccccccaaatgggtgtcccttacaaaccagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggtgagggagactagccctagccctagggcctaaggcagcccaggcaggagcctctgccactgtcctcagctctctgctaagaagcaccaggcaaacacctcccgtgttaaaggtttaggtttgcccaagagggccccacggcagcagtggacaaatctcccttttccttttcttctcagagccaactaaactgggctggggcaaagtgccctgaattctttgagcagttgggaggtataggtggggagtctggggggatggggagggacagagccaaactttctgaggtgaaatgttgggtggggggctcactgcttccttctccttagatcctctcttctctctcaggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatgtaagtctcttgaattccatccggtaagagggtgaggcccttcaagcctcagggccacactgccctagaatgactgagttagaagggccctttggggacagtctagcccagtctcactcccactgacagatgggacaactgagtccagagaggggaggggtagggttttcttacctaagatcatacagcttaagacctgactgaactgagtccagtgtgggaatggataagacaatccccctagagtgcttagcacagtggcctgcacagagtaagtgcacaataaatggtagctgctgtttattattgaacccaggtcttctgactccaagcccagtgctgtttcctctattatctttccaaagtatacctctgatagttgcttagcaaccttcagttgctccctattgccttcctgttaagtctaggcttcttagcctgacattcaaagatctttctgattctggcccaacttaccatggtagccatacctcctgtgagtctcctttaccctatccaccctgggttctatggtcaaactgaatattgcactggtaaatacctgtggttgtctccctttccttttctctgtcatttcctgaccctgagccacttccctcataatcatggaagcctttagcgcctgattcccttcttgctttcttgagcaatatctgtttcatttggatgactcatctgacactctacagctcctcaactccagtgactttcattctccactacactcagcaacccatttccatcattcggagctattccacctctgaaagctcacatcccagcatcccactcggtgaccaccacttctcgtccttctagttctcacccttgcatcccatgacatctgctctttgcctgcatccagatctccatccctccatttcctgcatcccttgaccttgcttcctctctatcctgtctgtggttgctcagttcggccactcatcatcagcaccttcagctttgcccatcctttggccatatctgacttgcaaacccctgagctggaattgatcctccccattctgcttcccctgctcctcagcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctgaaacccaaatctgtctagccctggcccctcccccaagattcagcctcctgtactcgactacatgtcagacatctccccttggatggcccacaggcaccttactgtgaccaaaagagaattggtcgtctcagtccccatctcaactctaaagtgatcttcctcctctgttccctatctcacttggtggcggcaccatctaccctgtcctgttgactctcgaatacttcccaaatctgaggttttgtgttgccgtgtctacttcccttagtgtctccttccctctatcagactaagcttttcaagggcaaggactctacatcagctgtccgtgccctagcacaccacacaagtctaggcaccaaacaggcctcagtaaatgtcgttgaattgaaccgtgctctgctctctcattcccagcagtgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaattaagtgtcaggcatggtgctgtgtttttttgtagaggttaacttcatttactttgacacagcagtcttgggaggtggaagtattatatattataccctatttgacagataagacattgaggctctaaggagtgatgggacttatctaatagctacacatttgttgatggtgggacagggatcttggcccaggtggtgtgagcccaaagtctaccttcatcccatcagcctgaatctgtgaccttctcagtcctgagctatgaccagacatactcgaggaagggggtgtattttaagattcgcatcacccccgcaccttagtggtcagactaatggttcgagatagcaggtgggtaatcataaacagggctgataaggcattttgccagtatcaagtgtctgggaatatttattattaatcacactaatggaccaccatgagaggacaaagtttctctctggcttttcatctgattagagctggaagcttttcaagcactttctccagccagccaatatcaatttaatttgagccactatcgtcttggaatatgaaattgcctccatagacaggatctccagtgaagtcatcagccccccagccctgcccccactgaccagtcaccctgcatatgtgaccagtctgcatgtgcccagagagaaaacagcctgctgagctcatggcccgtctgtgaaccatccgcatccatctgtgactgggtgcctgttaggtgccaggctctatgagaggctctgtgaggggtgctcaccctcctctcccctcgagctccccttcccagcagctctgtatctgttggtggttttgctgttggcgccgtcttttgtgtgcacagtgtcatcatctttaactctgcctgacccctgccatcagtcaccaagccctgctctctgtctgtctgtgtgtccttcacagcttcactccctcccatctccactgccagtgccccaggtcagccctccccgactctggcctcaactgtcggaacaggctcctccctggtctccctgcctccaggctgcctgtccaggccagcctccacatggtcacttggtgatcttcagaaacatagccttcatgtgtactcagaattggcaggtgaaccctcacacacacaccaatgcacacacttaccttcccagccctctcttcctcccacggctcctcagcacaggccgtgccctctagctgggctactcactgcacgcagcagcaccgtgtgcttgctcttgtctctgggcttcccgggccctacctcctgcacaaagccctcccttggtctttcctgccctcctcgtgctctctgtctccctcagccccgcagtgcctgcagtaggttcgcagtgctcatctggcctccctcccacatcctgctttgtcttgtcagccgctgctttttttttcttttcctccattccaggctgggctgtagctgctcccataaagggatcacagtttgtgttccacgcagaaggagcacagaacacttccaggcatatccttggagctcaagacaggttgctcagctaggccagagaagagagggatctgttcatttccagccctgcaggcctgttggctgttttgtgcatttatgtagcttttaagtgcagactaatagctatcatttattgcatgcccactatgtgccaggcactgtgccaggcattctatgtgagctttcttatttactcctcccaacaatcctatacattaggtatcattattgtcctcattttacctgagaatggaagtgaggcacagagatgaaccacagagtttgttctgggtccatggtcctgttgtttctatgttctgtctgctctactacactgcctttcagaggcaggtctggaagttcagagaccaagttcaaaccctggagtgttggggtatgaagtggcttgagattttgaatctttcctaccccatccctccctttgctcagcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcaggtaagaactactttgtccccacatggacttcttttctctttggctggctcttgaggcttccttctaccctaggaagagatggaaagtagcaggaggtagccaatgtgaggcaagcctggaaggcagcctggtgcatagatgacagctggcttctcccacctcttaggatggagcctgtgagtgccagggaccactgtcaggctgctggctacctcacataagagcacattctgagaggatgacatgggtgtgagccctgggcagtaacatagaggcagaagatagcaagaagtagggagtgtgtacatatatggttctgcacgtgtttttcacttgcagtgagacagtgctttctgtgtatgtgtgtgtgtgccttgaggctggctggtggtgagacaagattttgatgtgtgtattagaaagaaggaacctaggagaccgggcgtggtggctcatgcctgtaatcccagcactttgggaggccgaggcgggcggatcacgaggtcaggagatcgagaccatcctggctaacatggtgaaaccgtgtctctactaaaaatacaaaaaaaaaattagctgggcgtggtggcgggcgcctgtagtcccagctactcgggaggctgaggcaggagaatggcgtgaacctgggaggtggagcttgcagtgagccgagatcgcgccactgcacttcagcctgggtgacagagcgagactccgtctcaaaaaaaaaaaaaaagaaagaaagaaagaaagaaggaacctagggcattaagtcagagaaacaggaagtgagatcacaagacagaataaggaatgctgtgatttttaggtgagcacacaaattagtgaggccaaagctaggaagaggctgcagggagggttagtgatagggatctgctcttccttttgagtacccttgcttaggttaatgaacaggaacctcggaggccggaacacacagaagggatgacagaacagtgtggtgtctgtgtgctgaagcctggggagggagggagaacagctgggcctgcgtgatgtggggtgtgcagtggcagagagtgagaggggaggcagtgaatgagtttatagagaaagatactatggcctttgtttgtccttgtatggacagggtggaagggctggaacataaaacataaagtctgtctctctgtgtgtgtgtgtatgggcatgttcctgtacctgctggtcaaaccatagcccagtgacaaataacttagggcaaggagggctgtgttgggggttctttgtaaatattgaaagggaggggcattgacataagcagaatttgtgtgtgtgtgtgtgtgtgtgtgtgtgtgtgtgtgtgtgtgtataggaaaaagggaaaagtaggggcagttaagtcatggccaagcaggctgtcgtacagctttgtgaagaggaggcagggttgctgaaatccatgagggctaataggtaatctgtgtgagagagaagtgatagcattgaggttggtggctatggaggggtagtgggaacaggcagtgagatatagccatccagagatggcctgtatgttcacgccgtcactggggacatgtacaagggtatcaggctaaagaggcaggggtagtgatgtagacagcattggcgatattagtgatgacagagagatgatcgggtcagtgacagagcctatgtaggtagtggcccctgtgcacgaaggtgtctctgtatcatggagtaatgcaggacattaagacaggcacaacttccagtaagagagccaggggagggggatggacaagtagaggaacagtccttcctgaggagctctgggttacataaaaagctggtccagggttgacacattatagaatgccaggggcattatgacagggagaattctttgagtaccagggagatgcagaaggccagaaatggaatctacatggaatgcaccagtgaaggcttcatttgaaaacactgaatgcacttgtggaaggatggggagggacatttaatataatactgtgtggtaggcgtctcagtgatacgacagagagggatgggggatgtccggcatccccattctaaagtggagcatctgtatatggggggatgtgagttgtgaatgtggaaagtctagaacattaactctttccctttctcctttgccattgctccttatgtgtgtacacatgtgtggggaggtagggacaggaagattgctggttgtatgccagtgaatgaggggtgtgggaggcagggagtgaacaggacagtcactgagtgaaggacttgtgtatgtgtgcttctgtatacatatttgggtggctgtgaggggtgggatgtgtggtgagacagccgttccctagaaaaggggtgtaccttgtgcatcttggggcaagaactgcagggggcaggggaacatactatctcagggagtccaccctgagttgggcatgggggtgtgtgtgtatctctgcattaagaaaatatgtggtattcaaacaggcaggggagtgtgtgtgtagatttgtaggaaatctaggtcattcagctactctgaggtactggtgggtttggggtttgagggggaggtgctttgggaattctgggacatccagaccctccatgatgtgtccctgtgtgtgtgtctacagacagggaaataggggtgaagatgaaaagttgaagcagtgatacagcctggtcagaagttgttgtttgtgtccgtgtggaacatgcctggggaagtaggaaaagagcaaagagggacaaaaatgtctgtagttgtatacttgtatatgtaagcacatagagggggagaaggaccataaagaatgtgtggtgaagcactctggtggagaggggctcatgagaagtgataccgagagcagtgaagctggagatcctgagagagcccacctgtgctaagtggggtgggtggatggacagggtgagcaggcctgtgcaccagtcggagaaccagctcatcagcccagtcttgccacttccctttgctccacagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgagtgagtgcccatggcaacaggatttctcaccccctttctctgccacctgtgggagggagagaagacaaggtgaggtgggtgggggaggtagctgtccccagtcagggcctaaatgagtgaagtgtaagccccagtccctggctgggcccttgccagctctccctgtccctagtgtggggagccagtgaagtagccacacacagctgggcttggcatccctctcagattgcattcagtttgtgcttatggatggacgtgtgtgtgtgtgtgtgtgtgtgtgtgtgtgtgcaggcacacacacacattttgggaggagaagggtccatagctttcagcagattctctaactggtccaccactcctaaaaagtcaaaaatagatgctctcatccagctttttcacgttactgaggagaaaactgaggcccagaaaggggaagggatttgtctaatggtgcatagagtaatcagtaggcctccccacactgtccaggcaccttggtagcaaggcctgcacggggcttcatgctctccctcaaaactcgcctctggatcacaggcgtgggagcccttgggtcaccagggagccaggaaccaagcagcccttgctgaggggctatgctagtaacacaaaggagcccatccaaagggcctgtacattccagaatgctgggccattctgaccagataatcctgtgagtactagagaggaacccctgcgggcccctgaaactaagtctttccctttgctgcctgcccactccctgggagatgaacccctcttcatctgggcattctgggaaagggctatagaatccaggggccccagaagcaggccagacccaaggcaatgccatggactctgtccaaggccatgggccagcaggcctcttggagaagagaggtggcagctggggaagccaggagatctgtagttgggagtgggattcacatgtctgagagaggtgcccttacccctccttcccaaccagcctggccctgggtaaggatggcttattgagtaccatggatagcaagggtgaagtgtgggcagctggagctgttcagtcaagaaggaagctgattcagcccagctcccacacccactgtagtagggacgtttcctttgctgtggaggggcatgcccacccctgcttcttgtctcagctccacccctgacttggctatgtggccttgggaaagtccattcccatctctgggcctcagttaacttgtctgtaagattgtgggtgatgggaggtggtggaactagattatccgtaagggttctttcagctgcagtagtgtaaccatggatctgcctgagggtagggtgatggctttgctctcagctgtcaccctcacccagctggaaggaccttgacttgcgggaagcaggggaagcaagagtgttatgagcagggccagggagaaggagggcagagccaccctccctaaagcaatcttgcaatcgtgggcctagtcttatagcccaagcctggccttgggccccttaaccaggtgttgggtgtgggagggatccaggcccccaagctctaaggccttgaaaggatgtcctgttaaggcagctactttcaatgtcttgggagtcaggttatgtggggccccctcccctacctcaacccaaacagctctgctttaatctggtttatctactagggctctgcataaaacttcatttgaaaagttcttgcctccttccctcccttcctcaactgaggagagggccaagtcaaccctggggcccacacgaagtcgtttctcggatttgctccagtctctttgtaaagccaggcaggagagtgggcccatcccacagatacacacatgtcaagcactcttggcccctccagagcctaaagctgcctccttccctgactgacctcccactctctcctcagcaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactg

SEQ ID NO: 5707 - DNA, 12837 bp, human
gtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtaaggtggcgggttcggcccttttgcctgcgtgctggtggcgctgcacctcttcctttgtcgagtttctataaggccctgttctccagtcttcccctaagtcgcctaaagttgtccctctcccaaatgcctgggggaacgcggcagccatctcttgcgctaatcccgttagcggaatggaaagtaaggggttgtgcctcaacaattctcttgttatatctgtgaggtttacccattacctccaaaaagtgactttctcccaacttggagaggatgccggagggactagtgaggcctgagccagggcttaaggagtagattagtaccctagggtagatttccgattccaatggggaggaagtcttgcctgcaagacagtgtttgagtggggcgcctcagtccagttggtaagattgagttgggagccgacttacaagggataaggggctcctctagctcaatgagttgatttgggggtgaaagaaaggggtgtgtccacacaactgttgatggacagtctaccagttaggtgtcctgtatacggcctagtcagctcctcatgccctgtatactgttggatcccacagacattaccgtgtctcctcccaccttcttgttttgtgtctgttcatgctctcttgaaccagaatatgatgggtgtagcctgcaacaacctaggttctgaggtggagggtggaccagtgtaagggctctttatgatggtgctggactgtgaccctttaggtcaggcaacgaactccctctggcagtggcttctactgctgacctgatacgctgtaagctcttggatgtaactggtggcttgggcactgatgaacttagactgctctatggcatggcattggtcaggtaagacctgcatggggtaggggtggaggttggctttggggactggaggcaggggaggcatgtgataagcaaaacttggcttcaggtgttacctgaagcaaaaccctgcgtgtacctcactgtggatcagcctgtgattattgcttgacttatcagcttttggtaccctcgtcaacgcattcctctttttcttcctttttcctgaaagccttctcttccatttttctttctatcttggaatgtggaggaagggattcagaccaggtgatctctgtgggtctcttggtggtctgatattttttcttacctttgaattcctcacccagaggaacttgtctgaatggctcagggtcctcgcctgtgatttaatgtggactttccaaccctgtccctgtctattcctagcactacccttttccccttctctccctcatgaacactgaaagattgctgagttatggaagtggagacatgggctgggaattcctgacttacaaagtgactcataatggttctagctgtatacacgtcggaaaaaaaggttgctactgagttttcatatctgtcaaagtctttgcttatctatttccccttgtctgccttgagatcctccctttctcttcttattttctccattggttagctgtgctccccattatctgatgtagtcctttgcagcatttataacatattatgttctagcctaatatgttacattgtatcattattatttatcctagaccgaactgttcaaggctagagcagtgtcttattcatctgtatggcttcattatagggcagactctcattaaatgttggaatggatggaactgtccctgctctggctgacacaccagctgtaggaataggacaggacagtcggtggaaaagtggaaatgcagggtttcagtaactcagcaaagtgtttggaataaaatggttccttgggctgtgccacttatttctccctcaactccaggtttgtgaatcttatctcagagaggaagacaaagtttgccaaggtccccctcaagtgtctggctcaagaggtgcgtatgattcagtgaacttgctcaattctgtctccaagagggctcaccaaatggggcatggggtattgtgggcacacagtcagactagctcatcccatcactaccagccaagcccagcaagaatcccagagcctcagcttccagcctgaaggaggcacagttgctcccttgctctcatatgactggtatctcagagggcttggcctgcccagcttgctgggaggagcccaaatgtagcactgggtggggacaggaaagaggtgacagtcacagcacctgccctcatggagctgacagtctgagagaggagacagctcagccactatgagtcactttgtaaatcaggaattcccatcccatgtctctacttctgtaactcagacattcctaccctgaggagtatgtgaactgtgtagaggcccagagggcaggcatgctctcagtcattagcgcttcccggaggaggtgtaggagggaagcaggggtaaaggatactcagggagaaggacaggctagagggaggctggagaacgtgattgttaatgctcattcacaggtatttctttgttgtagaagggtggttggtggttaggggaggtgtgtgccttttatgtttctgattttcttttctttttttgagacagagttttgctctgttgcccaagctggagtgcagtggcgtgatcttggctcaccacaatctccgcctcccaggttcaagcaattctcgtgcctcagccacccaagtagctgggattacatttgtatttttggtagagatggggtttcaccatcttggccaggctggtctccaactcctggcctcaagtgatccacctgccctgggctcccaaagtgctgggattacaggcatgagccactgtgcctgacccacttttctgattttcaatacctcctccatagagcagtaaaaaaagaataagaagagctgtttttttttcttggctctgtcactgtgattggaatcttctttcaggacctcagtttctctagttgtaaaatggggcaggaggtggtcaggataattaatctctggctcccttccagctttaataattattttccaatttctgtactcacaccctcccctgtaatcaggtaaatattccggattggattgttgaccttcgccatgagttgacccacaagaaaatgccccatataaatgactgccgcagaggtgagtcctcagaggttatacctatcacagttaagcccaggggcctgggcttggtggcgctgagggtagagggataggcaggagggtctccacctggagtcaaggctgggactagggtgaaagaagtgaggcctcgccttgggcacaacatttaaagtggggagaagtcaaaagttccataatcaagataaataacatattaatgtggaaaaattcatgataaacataatatcaaaactttaagtaaaacgggattagtattactgatttctccttttgtttcagcttccaacatggcttggcatattttgataccttgactacagaggtttttttgcctgcccttaagttgttttttgtttgtttgtttgttttgagacgagtctcaccctgttgcccaggctggagtgcagtggcacgaccttggctcactgcaacctccacctctcgagttcaagtgattttcctgcctcagcctcttgagtagctgggtctataggcacatgctactatgtctgattaactttttttttttttttttttgagacagagtctcactctgtcacccaggctggagtgcagtggcgcaatctcagttcactgcaacctccacctcctgggttcaagtgattctcctgtctccacctcctgagtagctgggattacaggcacgcgcctccatgcctggctaattttttttttttgtatttttagtagcgatggggtttcatcatgttggtcaggctagtctcgaactcctgacctcatgatctgcccgcctcagcctcccaaagtgctaggattacaggcatgagccactgcacctggctgtatttttttagtagagctggggcttcatcatgttgcacaggctggtctcaaactcctgacctcaagtgacccgctcaccttggcctcccaaagtgctgggattataggcgtgaaccacagtgcccggccactccccttaaatgttgtttctcaggtagtgcctcattagtctcacatacctctccatagttgaggtggggaggttgccaggcatgagccatcagcagtgtcatgaacccaagggttccttggacatccaccccatcccgattaagaatcctggatttagcctcactctttgtgatgggaaaacagatctagaaaaggggagacttggccaaggccatgtaactagctaatggggctgattcctacttctgccacttactagccccttaactgtttttggcatctcgtctctaagtccaataataggtttttttttctagaaaaagtgctggtaagcaggataaagcaaagaacagggggataacccagagtgaaagaggctgcttctggatatttgagatttgaaccttggagccaagccttttcctggggccttcctataatacccacaagatgaggctggaggcctgctagctgcctgcctgatcctgtggcactgcctgccttcccccctctaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatggtaggtgttttggagggcagaaagcggcccatgagcccagaaggctcaggcttagggttaacgctgtttatttccctggctcagcatttcctctggggctgtggtgaatcttagcttaaaaaattactgtcacaaaccatcctcctggctagtttccatagtataatggctgtcacatttgcctcacaaaccatcttgagccctgtgaagtagttggggaaggaattctagttcctcaattacaactcaagaaatgaggtgagagaggctcagaatcccatcaggagaaggggtctgggctggcagtcctatctgtctccccattctgttttcagaaagagcccgagaactgctggtatcatacgaagaggagcagtttacggtaagaaagtgccctggacttggtgtgctctcatctgccccagccatttcttccctcttgccagctacctgagagaagtcttgagaaggaatttgaaagaaaagtgacaaagcgtgagggaacttctcggaaagagagaggggggaactaggaaggagacaagaggagcagagtccaattggctgatcctccacaccgatggaagggaacagatgatgaagtttgcggataatctgccccactgggtggtagggaacaactgggaatgggtagttgcgcagccctgcaattccgcagctgaccagtagatggggcccaagagcttccctaaatcaggtgagctggaggggtgctgtttttagggaggtcactcagaaaccatttagctcagcccttccttttcacagattaagaaattgaagccatggatgagtgaagggacaggcccaaagtcacatatacagttaatgatagaaccaggattagtacctggatctcccagttatctttcttctgtaactcattgcctctcctcatctctggccctttggcctaagagtctctatctccagccaaattcccccattgaacatctcagtatttacccacaggaaattcagttggaggaggaagggagggagaaggaggaggaagtctcacatttgagagtcaggctatttttagttgcaaggccagtaggggagttgtgggcccccccctgcatgccctgccctgtcccctgcagggcagtgctgagaggtcctatgggaagggatcctggaggggtggaggtgggttgcttggctgaaccagccttctgatgggaccctctttgctggcaggtgctggagaaatttaggtatttacctaaggccattaaggcgtggaataacccgtccccacgtgtagaatgtgtcctggcagagctcaagggcgttacatgcgagaacaggtgtgtaactaggtaaccgggagctgcgtattctctaggatagagggtagcagcctcattgaaatcggtttccctatcctagcttgccaacctctgctgtacaaaatcccagggataatcctgatcccctccacagtgaccctacatttggcagaactgtctgccctcaaccctgccaacttccaggtgggggttgcctatactagaatggccagaggcaggaatgcccactatcatccatctgctggccagctgctttcctgtctgtcgggtggcatgtggagctcttgacaactaggaaaatcccttgataattaccacctcactcactgcctagcccttgtctaagtttgaggtaaaagatatatgtatggtgggcactgctagtcttgtcttgttttttttttattttttatttattttttttgagaaagtgtcttgctctgttacccaggctggagtgcagtggcgcagtctcggctcactgcaacctccacctcccgggttcaagtgattctcatgcctcagccaccagagtagctgggactacagacgtgagccaccacacctggctagtttttgtattttcagtggagacagagtttcaccatgttggcgaggctggtctcaaactcctggcctcaaatgacctgcccttctggacctccgaaagtgctgggattataggcatgagccactgtgcctggccttttctctttttttacgatagggtcttgctctgtcacccaggctggagtgcagtggtgcgaacatagttaactacagcctcaacctcgcacactcaagaaatcctcccacctcagcctcctaagtagctaggaccaacaggcatgcactaccatgtctggctaattttataattttttgtagagatggggtctcaccatgttgcccaggctggtttcaagttttgggattcaagagattgtcctgccttggcctcccaaagtgctgggatcacaggtataagccactgcagccggcctggtcttttttttttttttttttttttttttttttttttttttgagacagagtttcgctattgcccacgctgcagtgcagtggcacgatcttggctcactgcaacctctgcctcccgagttcaagggattctcctgcctcagcctccccgagaagctgggactacaggcacgtaccaccacacctggctaatttttgtatttttagtagagacggggttttgccatgttggccaggctggtctggaactcttgacctcaggtgatccacctgccttggcctcccaaagtgctgggattacagatgtgagccaccacgcccgtcctggtgttttcttttgaactgccattggagagtattagcatcccttggatagtcatggttaggggaatagaggcgggaccttctcagggtctggctcctagagactaagttccttgtctctcaagtatggctgtgagcctttgtttccaaaacaaagtgctcagctcagtccagagcaggcgcatagtatgtctacccattcttctttcctccctagctcttgggggctttctacctaaattcagctggaagggctttgggggactttccgctaagaacgtgtggaggcaatgctaaacctcagctagagagaagttggagagtttaggtaggtggtgtaggtagcagagtaaccctgggtgagaactgcagtgtaggctgggattgcccctggagtcttctcttcatgtccaggatactcgttccaaaagtattttatcagtgtttgcccagcctaggtttcttggctctacccttcagcaaaagggttggtggtggcttcattagcagctgggaaaactatgcccctaacacagtagtgtctgcctggtaatgctggagagagggatctaagtatgtcaattttccaggcattaggacaacttgggagctcttttttccacgtctaggcttggtcagttaggagaatgtctatatctgtttagtgttgctataaaggaatacctgaggctgggtaattttgaagaaaagaggtttgtttgtctcatgcttctgtatcctgtatgagaagcatggtgccagcatctgcttctggttagagcttcaggctgcttcttcccctcatggcagaaggcaaaggggagtccacatgtacagatatcaaatggcaaggtggagggggagatgtcaggctcttttttaacaaccagctcttgcggaaactaatagaacaagaacttaatactgtgggaacagcaccaagtcattcatgagggatccgacccaatgacccaaaccccttctacaggcaccaaggtcaacattggggatcaaatttcaacataagatttggaggggacaaacatccaaactgtagcagaaagcctcttgggaagccactaactctggaggaatcagcttgctgttgctggtgtaggtttgagctattaacccatttatgccggaggttgcaatttctttcttttttttttttttttttttgaaaaatcagaccttggtgaagaccttgagcagtaggatataaataactcccacaagcttagcgttccaataatggaacactcggcataaatgggttaatagatagggatgagagattacccctatagcctactcctgcaacccctctaactttgttctgggtttttagaacccctagtaataaggcctatggaccatatttggtctagcagttgggtccccaaggtttctacttctaggatctaaaagaaggtagccagggagaagagaaggggtagggtactgaagaatggtcaagataaacagactgcaagaactgagtctaaaagcccttgaccccatgatcccaggcatttatttccttctgtggatgtggaactttttcctgtctgtgtgttgaagtgtattcagacactactgctctcgttatgggccatagatcagcattagtgcttggtaagcacttgttcaaaacccactgatcccagcctctaaccagcccctgcctgaggaggctgaagcctaagatccaattgtcaactcccttcctccccactcctacccacccaccacccctcctccctatgctgcttcagccacttgagccagaggcattagctgctttggaggtgggtggaggagtaggagagggtcttctgccagcatcactttgctaaactagtgtcctcttgttccagggaggctgtgctggatgcttttctggatgatggcttccttgtccccacatttgaacagttggcagctttgcagatagaatatgaaggtagggttctgggggctcactgcacccttagggttctgattcctgggtggaaacagctggggtgggctggggggccctgggttggggtgtgaaggctgtttcctgccattccatggcctctgaaagtccctcagccttcctggctgagcagaacaggtagccccactgacagttgtggggctgcccttaagtgctctggaatggggtggggtgggatggggtggggtcggggagtcttaatgacattattgtgccatgttcgttgtgatttagctgctagctagagagctagaacagcagaattggaggggccttgtgaggtcatctagtccaacatcctcatgttacagatggtcagactgaggtccagagaggggaaggtactgacccaaagtcacacagtgagttattgacaaagctgaagctagaaccagatctctgttttgtttatactttattttgagtcagttgttggttgccagatactaactggtttctctctccccactgttctgctctcctctttcctttgttctgcggtggcaactctgttgttggtggggggcttggctcatgcgcgcgcacacattctcttgctctcactctcacttcctttctcttgctgtctcttgctctctctttcgtgctctcctgctctctctctcctattgcccccccaaatgggtgtcccttacaaaccagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggtgagggagactagccctagccctagggcctaaggcagcccaggcaggagcctctgccactgtcctcagctctctgctaagaagcaccaggcaaacacctcccgtgttaaaggtttaggtttgcccaagagggccccacggcagcagtggacaaatctcccttttccttttcttctcagagccaactaaactgggctggggcaaagtgccctgaattctttgagcagttgggaggtataggtggggagtctggggggatggggagggacagagccaaactttctgaggtgaaatgttgggtggggggctcactgcttccttctccttagatcctctcttctctctcaggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatgtaagtctcttgaattccatccggtaagagggtgaggcccttcaagcctcagggccacactgccctagaatgactgagttagaagggccctttggggacagtctagcccagtctcactcccactgacagatgggacaactgagtccagagaggggaggggtagggttttcttacctaagatcatacagcttaagacctgactgaactgagtccagtgtgggaatggataagacaatccccctagagtgcttagcacagtggcctgcacagagtaagtgcacaataaatggtagctgctgtttattattgaacccaggtcttctgactccaagcccagtgctgtttcctctattatctttccaaagtatacctctgatagttgcttagcaaccttcagttgctccctattgccttcctgttaagtctaggcttcttagcctgacattcaaagatctttctgattctggcccaacttaccatggtagccatacctcctgtgagtctcctttaccctatccaccctgggttctatggtcaaactgaatattgcactggtaaatacctgtggttgtctccctttccttttctctgtcatttcctgaccctgagccacttccctcataatcatggaagcctttagcgcctgattcccttcttgctttcttgagcaatatctgtttcatttggatgactcatctgacactctacagctcctcaactccagtgactttcattctccactacactcagcaacccatttccatcattcggagctattccacctctgaaagctcacatcccagcatcccactcggtgaccaccacttctcgtccttctagttctcacccttgcatcccatgacatctgctctttgcctgcatccagatctccatccctccatttcctgcatcccttgaccttgcttcctctctatcctgtctgtggttgctcagttcggccactcatcatcagcaccttcagctttgcccatcctttggccatatctgacttgcaaacccctgagctggaattgatcctccccattctgcttcccctgctcctcagcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaa

SEQ ID NO: 5708 - DNA, 13150 bp, human; identical to SEQ ID NO: 4668

SEQ ID NO: 5709 - DNA, 27267 bp, human
tcgcgcctgcctgttccctccagcccggacccccctgaaatatgttcaggggcgcttggatgtggcccgggaaagacgccgccgcgctgactatctgctgctgctgctgctgctgggctcccaggccgagcgacaaaccttgcgccgactccgagcgggcgcagcgatggcgactgtccctggcgtccctgctcttcttcaccgtgctgctcgctgaccatctgtggctgtgcgcgggggcccggccccgggccagggagctgagcagcgccatgcggcccccatggggggccggccgggagcggcagccggtgcctcctcgcgcggtgctgccgctgccgccgccgccgcccggcgagcccagcgcgcccccaggcacctgcggccccagatacagcaacctgaccaaagccgcccccgccgccggctctcggccggtctgcggcggcgtcccagagcccacggggctggacgcagcttgcaccaaattgcaatctttgcagagacttttcgaaccgactactccggccccccctctgcggccccctgactccctttcccgtgccccggccgagttcccctccgccaaaaaaaacttgctcaaaggccactttcggaacttcactctctccttttgcgacacctacacggtctgggacttgctgctgggcatggaccgccccgacagcctggactgtagcctggacaccctgatgggggacctgctggccgtggtggccagcccgggctccggggcctgggaggcgtgtagcaactgtatcgaggcgtaccagcggctggaccgacacgctcaggaaaaatatgacgagttcgacctcgtgctgcataaatacttacaggcggaagagtactcaatccggtcctgcacgaaaggctgtaaggtaaggactggcttccgcagccacagcagccgccctgggcagcggcagcggccgcagtgggaccgggagaaaaaaggaagtctccctttctacccaccccaccactcccaccgtgcccagtgcagcactaccagtgccaccctgggaccttccctagtgaagaggcctcagggattcaggtcaggtaaccacctggctaacttctattaattccgggtttgggcaccttaggcctggggcttcctggcgccctgctccctcatgagtggggaggggccgcagggccctgggctgacaatgaggtggcaggagggattgtgctccccccagcctccatcctcagccagccatgcccctctcctttcagaggctggaactgaacgtcctgggactggctggtgcagggggaaggccaaagatgggaggaagaatatttggcaaccaaaccctcaccctttggcttctgccagtgggtgagaggacgagcactcctggtggtggggcacaccacacacttgaccttatgtgacctgaggtgactggccagagccgaggcaggtcgagcccaggggctgcctgtcttctcccaaggaagtcacctgcaggctcttctcccctgacaaaggaaggagctgggaacagggaacagcgactggtgggaaggccactgaaggttagtgcattctcatacaaaactcccagtgccttcccagcaccccatggtgacagtggggggaacactggctttctagctgctggggataggtatccagaggagaggtgaggcagctgcagaccggcccgcctagggaagagctgagtgttaagaaacttcttgaccctcggcggggttgctctggacagttaggtgggtgagggctgcaaacatttgggacttgatggtactgccctgctcgcccagcctggccaggtgacctgcctttgggaggaaagagaacagcaaggtcaaagggtcagatgacaaggagaccaggaggggtggtggcctcacacatcctcgagctggggccaagagctggagagtgagacagttgctttctagcctagctcgtgtccctccaagactttggggaggggcagaaagtgccattttccatccagcatggcccttgtggacttctgcagggcttccatgcttttagcgggttccctagggattggggcagagggttgggaaggaaaagggtagttcctcgctcctgacttcactttctccttctcctttttcctgctctcgtaacctagcagtctccctcccgcctccctcagcctcagctgactcactgcctcactcacactaccaaatgagatattccacttcttaaaggtatacagacagatagacacacacactgccatacaccatcaccaccaccccgggcaaagtcacataggcatgcagagaggtcgtcacacccacaaacagtgtcattagaagcagatgccgtgtcacacacacgcacatctccccatggtatcagagacacgcaggcagaagtactgtcacatgaagaagggcacattttgtcttacagagacacataccctcgatgtcagccacggacacatacactcagtgggagcagagagacagggtccacaagcagatggaatcaaggatgtctgttttttgtggccctcccttcaaccccatggccctgttttttgtttgtttgttttgtttttttcctcaatcaccagtatgaatgagaggcatgccacaacttccccatggggttttctccgtgttgtagttgactccgatttctgtctggacctgaactaaatacaaatctctcatgttgattgtttttaccaagcagtgtgacgtaggagaaatacatctgatctctccagttcaggaggccttatcacctctacttcttgttagtggtatgaccttgggcaagtcacttcacttctgtaagctttcatttcctcatttgtaaaacagggatcatcatccttgctctgcccacatcctgggtcttttgtgggaagaaggtgcagatgtattttgtaataagaatataacatctgacattaatgtaatgcttaaggtttttccgcccctctcgtgtgtgttatgagatcaaggaggctggtgatactagcaccactactcccattttacagatgaggaaactcaggtgcaaggggatcaaatggtttgccctaaggtcactcagctaatgagcaggagtgccaggactccagcccacgtgttttggtgccaacctcgtgcttttgccatggcctcacatcaagttcctgatggccctccctcctctcctttgtcttcttgtctgtctctctccagcaaaccagcgaactcctcctgtgctctcgctgcctgctgtgccggcagaagggcagtgccagctccatagctctcttccggcctttcccacccttgtccaatgctctctccctcaactgaggccagacccacctggctctcgaatccagctgtatgatgggcacgaagggaaaagacagccctgctaccctacttggactgtaggctcctctctcctcagtccctcaccccacctccctggcaggccttacttgccattcccaaaccccgttcctgggctccaagccctcctgtctggtccccaccccaaatgggatccctgcgagatgacgccccaccctcagagcttctcctgagtggagagaccacagccccaggccaagatgaagaggctttcttacttctagaaaccaagctgggaacctctgtttcagagccaggtgaccccctgtccccaggaccctgtactgagtgcatcagttagctcttccctgggtggccccagaaaccctgttctctgcctttgcaatatctgcccccgtttcaggccacacagggccccacgaatcatacctgtcctcgctgctgcctgtgacacctcccaatttagtaccagctgcaacatttccttaatgtgcaactgacttcctctcacacagcagggcaatgtaacttaggtaggccgatgcccttccccgccctggcctctcccaactcccagggtcatgcctcacctctctcttagcttcctgtgcatccccacaagccctatttcctccaacccccaccccactctcttggccatagctagggttactggacaaccaccacactcccccatggctctccatcctcccagttctgccacactcctgcctttctgattgcctcttcccccacctctgtctctttcctactctctcttcagaacattcagactagggggagtgatggagatgggggcaaaatcctggcttcttctctcatagctgttgatctgaggggaaatagaggcccaagggaggggcagttcttagctctctcaccagccatagggttgcattagtaaagatgagtgccagggaaggatgtgatagttctgctctattccagactgacccaaacccacctggcagacagtgtgtttgattttgggtctcacactgactgggctgagaaggaggcaggaacccatgttcttctggagagagttgaaggaggtgtttcacctggagaagaggtgactcgggcagatatgctgtctgacttcacacctcagaatagttgacatggtataaatgaaaaagcatgacctgcgtggccccaaagggcttttatagttagaaagttctaggttaaaacctagttcttttatttattacctgtgtaaccttgagctaaggacgtcaactctctgagcctcacttttctcacctgtaaaatggggctaattcatcgtaacagtcctgtgaggtcattattaatgagaagagtctttacagtacccagacctgccatatcagagttgctcagtttcttcctttcaaaaaaggaacagactgccttaggaggaagtgagctcctgctcccaggaagtgtctggcccgatacaggtggacccttggggaaaatgccgtggaggcaattctaacaccagattatgagcagagttggaccaggtgacctttgaggtatatttcagcctggattttaggcctgtgagcaaagcttgctcattgaacagcagcactggatggggagggctggggaaggaggttggtcctaacgcccacacaaagagagggggtggggggctgccagagccagcgccttgccttctgcccgtacccgctggggccctgctcttcctccactccggctggcagctgtttctgcctcactgccttcctctctcctcccacctgccacagctttcctgccaagcaggactccttgctaacactgggtatgaggggtgctgagagcagggagctcagggcactgggtaaaggacaggagccccaagttggccagtggtgtctgttttcatcacacagcttgcagtcaggaagcagtgccccacaggcagcctccctgacccagggctcttagagccagagaggtaccctggtccctgtttgggggtagaggaaggggcaggctgtctataaacagcctcccgggagccatggcaaagcctgcccttggggaggggcctccagatccacagaagctcatctcttcaccaaggaatgtgagcatggggttctgggaaggagcaggagccaggaatcctggagcaggcagagagaggaggcaatgtttatagtgaggacaagtgaggacccaccaacatcctttgttcagtgtcccagtctcttgtccttggacccagtgacaatcactgttaccttcctggaatagcacacagtgaattaagactgggagtgggaaagtggtcactcccaccctgacctgcccccactccaacctccatgttcttcccacgttagctcacacccaacatgcctatccactttccaatgaccctacaaccttcccaatcttctacttatcaccctacgctcttcctaagccacacccacaccttactccctctacctacagtcctccaacccctgcccctcctgacagttatctccacccccttccacctcaactctggacctcactccccacctctttcctctcaacagtcagcccctcacattccacattactccccctattcccatctcccacctgacacccctcccaaacctttactccaagatcccacaccctcttctggcctgcatgccccttgggccttgcatcactcacaccccactcacactttacctcccttctccccatcctttttcttgctctctttcatcttctggtcctctcttccaccctctttcctcctgcctccccctctccctctctgctctctttctcccacttcccttctctcgttaccattcagggtagacatgtacatgtgtgcatgcacacacagacacacattcatacagacacacatcccccggtcttcttcatggctacttcccatccttcccgcaggctggtgcctgactactacagtcaccatagcaacgggaacctccaggaaggatacactggtatctcctgaaggtgggggttgggggagttaggtggagaaagggagcctaacagcctcccacccaataccatggtctggcaggaagagtctgctgaacatggtgaaggtgggagtgaggaaagggaagacagtgggtggaaccaagatcaaaggagggtcaagaatctcccaacacatcgtaagcatgcgagggtgcttctaagccatgcggatgcatgttggtcccctctggatgtgtcagtaccctaaggaaagggtatactcacttttttacatgtgggtagggacataggctgaacctcagactcaggggcgggagtgtgccttagaaaaactcctttggggcagttattctgtgcccccaccctctgaggcagtttaccttctgtgtgcccatacagactgggcatcaaacctgccctccccagctcatttctcagccacatgtggattccagctgccagtgttagctgaaagccaggggtggcccctgcttctggggatctggacaaatctggacccctacaagcaccattctccgatgctggcctggtaggtctctggggaatgggtatgtttgcgttttgtgtgattacaggcacacagaccagagtgtgtgcaagaggccagggatgctggaccagccttttctccctgggcataaaagtgggctcagtaacgcctgaatttttgatactgttagccagataggtgcttagaggggagggcaagggcaccaggcgagctgcagctggctctggagagggaaggagttactatggagtgacagggactgccagggccaaagctcctgctcgaatgcattctggagaaaggagctggaacctgagccacaagtctgtgcaccagaagatgaggccaactggctgcaaagacgaaagggctaagaaaggggaaggaaagaagaaaattgcgagtctttgagtgcctaggagatgccaggggctttatatatgttcatgaactcatttaatcctggcagtcatcctagcaggcaggcactatcatgattcccattttacacatgagacaactgaggctcagtgaggtgaaatgacctacccaggccacatagcaaaaggactggcatacaaacctaggtctgtctgttctttctccagtgcacagatgcatgaagaaaatgctaataatctcctccaactgtcagaggtagtgcccagctggctactgagaggctgggctgagaagctgggccgactggaagggaggcccaacagagcctattggtagcttagaggtcctctggagtggcccagatccaaaacgaggacccaccaacatcctctttgttcaacgtcccagtctcttgtccttggacccagtgacaatcactgttaccttcctggaatagcaacaagagaatgggcacagggaaggaactgcaaaggagatgggaggacctgggctcctctcgcctggagggaaggtatctctgttatattctcagccccaatctgctggagggatcaagcagagcacgaggggagaaggtgcagaacattaacctaagttagtccctaagcaggcctaatgcagacctgagaccctggcctccacatccactacacctcaacatgtgcagtttctccatatccttgcacatgctggtagagctggaagggaaaacgactgcagtaagactttgttgccccagagtccgctgaggcctggcctgggctttggatgcccagttcccatgcaagggttttggtgagcccctaaacttgaacacctaggcttttcttggggattgaaggaagtgccagtccaccaagttctgccagaagaggggcatttggtggtgatgggtgttaccaatgttccctgtcttatttggttttaagaagatagcatggctacctggctgatctgtgaaaggtgagcttgtctgtttagtgttgaactcattaaaacttccaactaagttaatctcttagaattattatagtctcagaatcttataatatctttttttccagttaaccaaaaaggcctttgagaaattttggaaagtagaagtataaaaggaaaaaagtcccagagcacttagtcttttttttttcccgtggtaaaatgtacataacataaaatataccatttcaactatttttaagtgtacaattcagtggaattaagcacatttgcagtattgtacaattatcaccactatccatttctaaaacgttttcatcctcccaaacagaaactctgtgcccattaaacaagaactcccagccgggcgcggtggctcacacctgtaatcccagcacttttggaggtcgagctgagcagatcacctgaggtcaggagttcaagaccagcctggccaacatggcgaaaccccagctctactaaaaatacaaaacttagccgggcatggcggtgcacacctgtaatcccagctactcggggtgagacaggagaatcacttgaacctgggaggtggaggttgccgtgagctgagatcgcgtcactgcactccagcctgggtgacagagtaagactctgtctcaaaaaattaaaaaaaaaaaaaactccccattcttccctccttccagcccctggtaagcattattctactttctgtctctaggaatttgagtaggtacttcatataagtggagtcatacactatttgtccttttgtgtccagcttatttcatttagcatgaacatttagtgttcaaggttcatccatgttgcagtatacatcagtacttcattcctttttatggctgagtaatagtccattgtatatctatgccacattttgtttatccattaatttgttggtgggcgtttggattatctccactttttggctattataaataatgctgctatgaacattggtgtacaggtatcctttgagtccctgctttcatttcttttgggtttatattaatacctaggagtagaattgccagatcatatggcaattctatgtttaactttttgtggaactgccatcctgttttccacaatggctgaaccattttacattatattacattttatgttatacattctgcaccattttacatacataacagcagtatgcaagaattccagtttctccacatccttgtcaacacttgttattttctgaagtgttttcgataatagccatcttgatatgtgtgactatatatttttacatagttgaaatcatactgttttttaccctgctcttttaaacttgttacactatctcttcatgtaattaaatattcataaacatcattcttgatgagtgtacaatattccatcacatgaatgtaatgtaatttatttaactagtcccctattgacatttatgttacttccaacattttgctattataaataatactgtgatgatattctttgttcataagtctgtttcagaacgattcttttttacgaataaatgctatctcagtcattttttcttatttatctactttgctgagtttttaaaatcacaaaataatgcatgctgtttgtaccaaatctaacaatacagcggtttataaagaaaacattaatgttcctcctattagctcccctcccaatcccactgcctgaggtccctgatgttaacaatatgtagtgtgttctcctgcccctctgtgcaggcttacataaacgtctacacacaaaatgactttttctttccttttgcatacaaatgggagcatagacattaattctgcaaggtgaagtttcagagctagatgtacagaatcaaagagtattaacctttttgaggctcttgacatacattaccaactttctttcaaattactgggttattctagtttataccctcaccaaaagtgtgagactaatatgcagcacacttttccagtattggctatcacatctttaaagctttactaatttggtagttgaaaaatggtacaacattggcttttcattttcattccttaggtcagacatttgtttttcttgtttataggccatttgtcttgcctgctttgtgaattatcttttcatgttttgtgttttccttactgactcgtacatgcttttttgtatgtattaatgatattaacctttttctaatcacatttgtggcagatttttttcatttgttatttgcaccatagagctgaaaggagggaatggaaaggaagagaactattccacacactttgtgtcctttatcttacttaattcttgcatcttccttatgaagtacatgatattattcccattttacagaggagaagactggctcagagaggttaaatggctagcttaagctcatccagctagtaagagttggagctgggatttgaatggcagcagacaatggtaccacccagtctttgctggtgtaattatactatcggtaaagctttgtgtggtaaagctttgtgctagttgcttaacaggcataatttactgaaaagtaagggtaggtacttttattatctccattttacagatgaggaaagtgtggatcagggaagtccagtaacttgcctggggttttataaccagtatgagcaaacctagggtttggactgcatgactgagtttaaagatgtttgaccctgtcttcccactgtatttgattactccctaggcatcaacttcttggatccaaattgaggcccaggaaggaaaagtgcctttctcacagtcaccagaaagttagtggctgagtccctgtctccctacaggtggtgacttgtccaaattcacacagttggtggcagagccagaatctgaagccagctctaactctctatctaactggagcaggggcttctcgatgaagagaatttgtggaatatgctggggagaaggagttggggagaaagtggagtgcatagataccctgagacttttctgaaggaatggactctggcattggagtcttccagggcaaggctactctagaagcccccagatggtaggacctgggacaggagaactcatgttctgaggcaagaaaatctttcttctggagacatttgccttcccttcaccaactgctaaagattaaaacaggaatagtgagcctttggccctgggtaggaagctgatgggcgcagaagaagcaaagcagtgtttgcctctttttaacacctccatctctcagggtgtgtgtgtgtgcgtttgtgtgtgtgttgaggagagagagaaaggaatactttgattgtggaatggaaatgatcatttgtagcacctaatatccaaatgctattcccccacatctacttacaaagaaaactttactcatgtggagaatggactacgtagactgattttagagtcacgcctcccatccagacatacaaatctctccctaatttgatgtgaaattatgtcagaatgagatttgagtccactggcttcagtggttgtagtgaattgaagggaccatcccaagggcaatatgagtataagagtttagacaccgaagtccagattaacctgacttcaaatttcagttcgaaatctgtcttctctgtggaatagctgttgagaacttgaacatattctttaatctctattggcatctcattttcctcacctttggaactaaaaaatagggtcattatgaggcttaaataacatgaagcatgctaatctcttaagagcacagtgcctgcgagatggaaagtgctcaagacatgctagcccccattgttattattattattggctgtggaccttggacaagttatttaaactctttggtcctccctgtcctcatctgtaaagatctgtctctacctcaagggatagttgtgaggtctcagtgagttaataaatgtctgggtcaggtgattagaacagagcctggcatatagtaagcacttaataaatggtagctattattattctctccttaattaggtgtgtttaatccaaatgactgcttaatatctaattgatgttgacaacactggggtgggatacttaggagtagggaaaggtaatttgtgaacaggaggtgaagtatctatggtaggggatgaggagccagaaggcaagtggagggattctagtgagggaaggcacaaggatatacttagatgggggaggaaagaggcagagagggagatggaaagactccaaagcccttgatttacctcatcactaaagaccaagcacagctgacagtcatctttgatcacatctctgttctctccagcctctcatctttctggcaaggcacagcatttggaggaggaggtaaggatctgtctttggtgatccctggagaaggctggagattgcttcctgggcctgggcccaggtatagctgtatgtggcaaacaagtgtgcctgggaaggggaagtgtgtgcagctgaagggaacctgtggctgtcactgtcacactggcaccattcctgtggtactctgcacaaccattgtgcacagaagctcccgaagctcccaaagctcccctcgtctcatcttagtcctctgtgtggctatgggacccctcattagctctgttgtcctgataaatttaccatggtccagacagtgatgatggagtagatgatccagggcagggcagtgcagggcctggggctctgcagcagggcagtgtgggctgagtctagcgaggttggtcaggtcaggtcttggagattttgttttgttgttttcgaggttcgtggctgcaaagcagtttgtttttatttaaaattcactttatcaaagtactgtattttcataattttaaaaggcatgtacaagctatatatatatatacacacacatatatatgtgtatacacacacacacaccccaagcctcactcttcagagtcaaacacttgagacactcttgactgtttcttctgatatttacctcaatatttctaaatggtatgctaatattgctatttcttgtttttttctgttttaaatatttgtgtatacacacatgtatagatagatattcacacatatacatatatacacctgtgtgtatatatctcatttatatgtatccttgtagcttataaagcttttaaattctaaatataaaatatctgttaaatgacatatatagatctcaatgcttatcattaaaacagtagccctctactccacccctgagcctcactcttcagaattaaatacttccaactctcttagctgttttcttctgatatttacctccacatttctaaatgccatgtcaatattctatttcccaatttttctcttttaaatatctgttgacttttaaaatgtgattaaaggaagatttagctcttttactcccagcagcacttaagatacacacatgcttcccctcccctcatacattcaatattggcaaatcaaaattcctgattttaacaatattccatgtttatattactagaattataaatattgttcacagctgagttatgtagaatactgtgattatatttccttccttggtcatcttgtttgcatggagttaataattgcctcttgttttctgtttgcttagttttctcattttttgctgataacattcccaatttctttatcagaactataaaatctcacacaaacactttcataacccattattttcacttttttccttggagctctccaccttgctctagttgctagaggtttggttttcaagtacttgtcaagtacctctgtgtgtatacctcctccacttgtatacccagctccatgtgaggccctgaggacagtggacagatgagtaagatacaatctgtccttggtgaatctacagtctcatgagtgtataatttatagaaatgtcttaccagaaggctgtgtgttaagactttgatctaagctgtccctttggtcccacactcaggcaggcctcctcttcttcgtttcccatgagttaccagaatgtgatacagtcctccaaagagcaaatgtgatcttaggctgcattaacaaaaagtttctaggacaggagggctgatgcctctacttcactttgtgttgataaatcctatccggggattgtgtgtagttgcaaaggacatggaaatacagggactcatctgaatgtgaacaaccaggctaacagaggactggaaaccacatcttttgaaatagttgaaaaaaaattggggatgtttggcttcttgaaagagtagtctacacatagctatcttcaattttattccctcacatttccttttcaattttctacaggctggtttctgcccccactgctccactgaaactgctctcaccataatgagactgcctcttaattccccaaaccagtgtgttcccatctaaatccttatctgctggccactccctattctttgaaattctctcctcccttaattggcagaatgcctctcttctgtttctcctccaatctcttgagccactcctccatcttcatctgattcttttcctccatctgccccttaagtgttagtttttctagggatctactgttgatcctaggcaatgccatccactttctaggcttccacaattgctgaagcagccagggtgagctaggttatgctctggtaacaaacaacccccaaatatctgaggtttagcacaacaaatggttacttctttctcatgatacgtgtctgaaacaggtcatcagggaacatctgctcatgatagtcaccaaagacccaggatggtagaggatccaacataacactgcttccacagtcagcatcagagggaggagaatgtggcaaatcatacatttgctcttaaagcttctgcccagaagtgactcatgtcacctcaactcacacttcattgtccaaagcaagtcatatggccgtgcctaacttcagagggtgtgggaaagtgtagtcctactatgtccctgatgactaagtccctaacccctgatggcttccaagcctttatgcagaccctccttctgagctgactgctgtgtccaactgcctcctcaacatttccacctggctgactcacatatacctcaaagtcaacatgaccccaaactgaatttatcgtcttcacccccaactctatgcctcctattttccctgacttaataaatgaaactattcatccagctacccaacccagaagcttggtcatcatcctggatctctccctctctctcattccccacatccttaaataatcctggtgattctacctctttaacatctcacatccaccccttcctccctatttctcaattctgccactgttgccttagtcggggccctcacaacctctcactcagactgttggaattgtcttgtaactgatctctgtgcctccggtcttgatgcctatactccatcaaccacactttcagacagaagtccgaaaagttagtcatgggagtggcaagccatctttaagtaggcaattatttgaaacctattaaaggctctccattgcctataggatgaagcccagctccttgtcagcttccagagcatatcataaccatggccatggccttcctctgcaacctcatctcccattgtatcccactttgcgccctctaactatgctgaactacctacagtctctaaactcagcactatttcacacttccaggcctttatgcctgctcatttctttgcttgaagtgcacttattctttccatattccacctagttaccttctactcatttttttttcaatccctaactcaaccctctcccacatggagatgttttcctgtccttcagccctcaaaacacagttgatcactcctctcttaatgctactactgtaccaaggagatacagtgcttcttgacttacaatggggttacaccttgataaacccattgtaagttgagagtatcttaagttgaaaatgcatttaatacacctaacctaccaaacatcagagcttagcctagcctacctcaaacgtgctcagaacacttacattagcctacaattaggcaaaatcatccaacacaaagtgtattttataataaagtgttgaatatgtcatgtaattcattgaatactgtactaaaagtgaaaaacagaacggttgtatgggtacttgaagtatcatttccactgaatatatattgctttctcactttggtaaagttgaaaaagtgtaagttgagccatcataagttggggactgtctgtgctacctatcacagtgacttaaaatgattgattcatatagttgtctcccctgctccctgaagacaggaatcttgtcttactcatctctattatctgtagttcccagtacagtgccaggcactcagaagatgttcaagaaatgtttgcatggacaaataatgagaaaaacagactcagagaagtctaaaaatacctgcagggttggcacaggggacaggaaggtagctgttccatatggcaccagtagagctagtaagagctgcgagtgaagccacaaggaggaattagttcaaaataaggaagaacttctgtaactgctagagttatctgaagatatgggctgccctaggacagcatgaccccctgtgacaaggcttacaatcagaaactggataagcacttggcagtgatgttggagtggaaattccaacagcagatagggcagtgttgtgatggttctcatggtcccttctattctggaacagtcatgaccctgactcctctgctcacctgattgacagggattatctaggccccttcagagctgctcctacattaggaacactgtttctccactggaccaaccctgtccaggctgggcccatccagccactggcctttgagcagatggcccaagaggcttggtggtgggagagctttctggaactgcactggctctaggttctcaccctcctctctggccatctcccctgcctttccttcaggccatgccactttgactcatgactgctcagtttgagaagcaggacagctgttgcttatttttacagccacttaagtagaaccctattatccacctggatttgccctttaatgcatctaatcccagtctgattctaccaatcccagtgaactactgtccccagagttatgtccatgatctccttcctctggttgaggagactgattttgacctaaccctgttctgatccaacttttgaaagcccagagtcgggactaggagcacttggctcttttcagaccctgcccgagggggttcctcacacacttctctgtgtgctgatggatgcagtacaaagaggcatcaggttagcagtcaggttgcctcccttctaatcatggcttatagttgatttcttgcatgcctctgacttggctaagccaaccctcttctttgggtctcagtttccctatgggtaaaatctgggagcggagtgtaccgtggtgtctgtggacagtggatttcatccccatgtgtagctcacattgctgctttgcctccacaggctctgcggctgcagctccagctgctggccaagggccccaagggtacattaggaagacaagcagccctggagagaaggcctatagggaggatttggatggggaaacaggccccagggatggaagcaagttagaatccatgaaggaaactgcttacttcctggttggcaagaactaaagctctcctccctggagggcttttcagccccagaaccaaggagctcggtatggcctccgctttctaaactttctggccctgagtcctggctttgggatgtaaaagtcttctttctagaggagagtggggatgatgatgccctggccagggctgcaagcgccagagccagagggtaaggctctctgggtcctccctagattggcaactgcagagcccaggaggggtggtgacacctctcatcttgcccctcccatttctggagtgctctgcagcccagctgggaggagggatgggacagccttcgcagcttcctttttgggttaattggtgttccctctagttatttcctgctcccttcccctcccagttcccatagcaactgggctgtagcagccagaacttgattgagcccagcagtggcccgactgaggtggggaaaggagggcactgccaggtcaatgcttcccaccccacccatcccccgctgccatctcaagggttcaggatggttaagcccagaggacagggcataattggaaagccttttatgccagggctagagtttgaagagtctaacatgccagagcaggcctggttctcctcagctctcctcccctccccatgccctgtgtcctgcctcttaaattttgaattcactgttgctggtaggattgttcagtaggaagaaccctggagttggaggtgggaaaccaggtttccagttcctcccaaaccgatggttctcaaccgtggctgcatactaaaattgcctgaggtattttgaaaaactacagatgtgtaggctccacccacaaggattctgacttagttggtctggatgtgatgtgagccagacaggagtattttttttcttttttttttttttttagacagggtctcactgtgttgcccaggttggagtgcaatggtgtgatctcagctcactgcaacctcctccccctgggcaaaggtgaccctcccacctcagcatcctaaataagtgggatccaaggtgtgcaccaccacacccagctatgtttttatgtagagacagggtttcaccatgttgtccaggctggtctaggactcctggactcaagcaatccaccagcttcagcctcccaaagtgctgggattaccatcatgagccaccgcatccagcccaagacaggagtattttttggaagctctttgagtgattgtgatatgcagccagagttgagatcctggagaacaaaagagctccgtagttcacccagaactgactgttatcttgttctgagacatttcttccctttccctgcatcccttgcctccagcaagccccacaactctcctaagccgggccctcctggctttcctccatccttgtagacaagtgcccaggaacctgtgaatgcccaaacaacctcccccgtcaacccctggctcagtcctaacactagtgaaacagggcaagctacctaggtccatctaagaaacagggctgcagagtctaaggcaggcttgttgcccaagctgtaacaaacactgagagccagatctttcacctgagaaggaccccaggctacctctgaggcatgagggatagcaatggcctccgctggccggctgtggggctgaggaattggattacctctgagccccacatcactcttcttcctccattcccctcattagctccttgcctgttcctgcctcgccacccacaggcctggtgtcctccccaagcaatctgctcacccacttgttgtcatggtgactctggctgggggtgtggggactgagtggggaggtcgtctaattaaggagaaaggccacactcccaatgtcaggccacccctcccccttccccaacctaccctggctggctccctccattcctccctccaggagcagatgacgggagcgcccagccaccatagcctgttactgggctaattgcagttgcctgggaggagggcaggaactccactggggcctcctcacctaggagctggaacactgaactagaagagcccagagagaattccacagggacctctgagtcacactgatggatgcagggttgggagggggccgattgcacacattttggggtgagggtgaggcaggctctgggtccaggctacagacattgaggcagagcctatggacagagactcatcttggcactctggggctcaaaagatggagggaagtctctaaggtactgggacccttagttcttgtaatttcatgttctttcctgccttacttctgtttctttctcctccccttcttgcgctctcttattcctctttcttagctttgctttcttacagccccatctctcttagccactcttattccatcttattcacccccgcttgttcttacccatctttcttactccctctttcttaccgcttcctcttaacagctccgcttacccctatctcaccctctgttatgtccctacctttcaacttctttcaccctcaccccactcttaacccttcacctcccttacaccctccacctctaattccctggctctttctccccaaccccgttgtttcctacccccactattcctaccattccttaccctctctttgctatacacctcctgtcttccaccccttaccccaactgccactctctcatacccctcaaacccctctcttcctgccctcctttaaccctccagctctcttaccctgcctcctattttcacctgttttttcaccctcctttcactcttttcccgttccttttcacatactcttttagcccagtaatttcatatttaggaatttatataaataaaatttaacacaagtgtgtgagagatgtgtgtataaagacagtcactggagcgttgttcataatagtgaaaatgtggaaataagtgtccatgagcaagagatcaccaatgcccttttcattccattcatacaaaaccattctctgttctcttaacacaccatggatttgtttgccgacatacctttgcttaagctattgtctcagcctggaatgcccatttacctcatctctacccatcccatctaacatcctgatttgagtccaagctcaactgttctcccaccactgaaatctttccctgcttctctacttgcttccctccagtggtccatggtttgaactctcctttctatagatcatatgccatagattcaaattagatgtgtctacccatgaaactggaattttcatgagcgtagggacatgtcctcatttacttgtcctgttcattcattcaacagattttttaaagtgtatattgtgccgagtatacaacagttaataaagcaaacccatgtctgcttacgtgcaactcacattttagtggggctgacaggaacaaaacaagagtgcagagaaagtaatacttgtggtgaagaaacaaggaaaagagaataatgagggcagcatcctttggtgagaggggtaagggagatcctctctgaggagaggacatttaaactgagacctgaaaagtgagaatgacccagacatgtcaagagtagggggaagagcattctgggccaaaagaatagcatgtgccaaggccctgaggtgggaacaagtagggcatgttcaaggaaaagaaagaaaatgaagttggagagaaagacaggagcaaagttatacgagggctagaagtctgtggtcagaagcttaattctaaatgcatcaaagggtttggagcaaaggagtaacatgagtcaattgcgttttgagaccactcttcctcctgtgtggacagtggattggaaagagcaagggtgcaggtggagaggccagatgggagactgtcatccaggtgagagatgatgatggcttgcccaaaggcatagatgtggagctacaattggcatgccttgctgatggactagatgtggggatacagagaaacggaaatgaaggctgacatctaggtttcatggcactcactgaaatggtcaagacttgaggaggacagtggattggggattaaaaaaataagatctacattttaaaatttataacatgttaaatttgagatgcctgtgagataccgaagtcccaagcaatgctttgctctttgggggactggttagcaacacaacctaccccatcacccactagtacctccctgctttggaaaaggccagtgtgggattgcattgccaaagtccatgttcacagcagttatttgtagtttagtgaaaatgtttgaagtaagtataagaaactgacagtgcttctgaaaccatgttgctcagaatatggtagaagagcctcctgtggcacagtgacctggacctggctcagaaatgcagattctgagcccacctccgtcctcttgaagctgaaacagagggagacatctgcatattttaacaaatgcttcagggggttctgaggcactctgaagtctgagaaccattgctgtgaggaacaacaatgaacctagaaagcacccctaaagatacaggactggatgtgggtggcaagacaggaacaggcaaggtgcatgagagccatctgggcatctgttaaaatgcagatgctgacttggcaggtcgggggtggagcctgagattctgcatctctcacaagctcctaggtgatggtgatgctgctggtccaggtccacactttgaagagcaaggacctagatcagtggatcagtggttgacaactggagacaatacccctaccccaggggaacatttgacaatggctggagacattttttttggtttttttttgttgttgtttttttttttggttttcacaagaggtgaggggagagaatgctactactgtgtaatgggtagaggccagagatgttgtgcagtatcctgcagtgtacaggacagcccccacaacaaagaattatctgacccataatgtcagtagtatcactgttaagaaaccctgggcttgatgataaccaaagagtatggagcagggaatcttccttagctaggacccagtgcctggtaggagtggactagatgagggacaggaagcatacccatgaagtgaaactgcaaagcagaggttccaaatgaaacgtagcagtgtgtttgatgtctgctccatgccagagcggaagccaatagggcagagcatggatcaagtagagctcaaaggcacatgtgttgcctggtaaggcaggttcctggttttttttttattattaaaaataacccctcacatttacattacacttcagagtttacaaaacattttcatatatgccatattatttcatccatacaacaccctaatgaggtaaagcaaggattattctttctctttcttgaatttagaaactcaataccatcagccaaagaaatgtttgctgaattgaacagaactgacatttgcctcattatatataggtagtctcagacaagtcagatacttccttggaccaagtgtaaaatgacagggttgcatggaatgattggcaaggctccttccagttctgaccttccagtaattttgtgatctttgccaacacacaaattttgagtcttggatgactgcagactggggtgcttgggagtactggctatgaaatcggagatcttaggtaagatgcagtggccttgatccaagcccttcttcctctctaccccctggatcttggggttaggttggtgaggcccccttgagagaccacaagtaagtcctcccatccctctcctctgaggtgggaaggggctggcacatgggctgatgctctttcctctccccacaggctgtctacaaggcctggctgtgctcagaatacttcagcgtgacccagcaggaatgccagcgctgggtgccctgcaagcaatactgcctggaggtgcagacccggtgcccctttatactccccgacaatgaggaaatggtgtacggagggctccctggctttatctgtacaggtaaaggcagggcactggggaagagggaggaggccgggggcccagggcaggcatcaggtcagaggagttgggagcagggataacaacaggggagtcaggtgagaagaaggccagtggctggacgaatgggcagtgacgtccccaggttgggatagggccaagtggaatagggaaaaagaccagagtgtccttctctgcccaaaacatgtccagggagtcatcccaaagaaactggctggggtccccaggaaagaagggctcagaaagggcaagtgtcgagggctgtggggagggagccttagatgaggctacttgagcagccccagctctggaaacttgctccctaggtaaggcatagctatcagctccccgagcaccccaccacaccttccttatccattggcagggttgctggatacttcaccaaagcgtctggaaaccaagtgctgtgacgtgcagtgggtctcctgtgaggcgaagaagaagaagttcaaggagtctgaggcccccaaaacccaccagcagcaattccaccactcctatttccaccactaccaccaacagtaccatcactaccacccccatcatgatcccccaggccgtgtcagcaacaagcccgccctgctgccggtctctgggggctcccgcctcagccctagcaggatccggctctgcgtccttgttctcatgctcctccataccgtggtgtccttctccagcaaccagggtggtgggggattggggctggagacactgcctgccctagaggagggcctgacacgggaagagtgacagtagggagggaggacagacctccaccacactgacatcagctccagctcccccaggttgggggggagggggctcctcccatgggaggtgtaggataaggtgggggcgggggaaatgggggaatgacacatcccccccaacctacccccaccccaaaagcagctccaacagaatggccagagggcctcagggagctgcaaaactcatccaggagaaaaaggcaggagcagcaagtgacccctcccaagctcccatctatggggcttagcaaaaaaagggaggaagtgggggctggatatgcccacccctgccaaaagccctgaccccagggaaggaggctgctcacccagccttggccctgcagggaatgttggggggcacagaggggagaagctctttcccccactccacattccttttgttgccaagatccttaattccctcctgcccatatccctacaggcgacggcagacagtgcaatggccctcctgccacttcagcacaccttgccccacctgggaccatcacacgtgaagcaccaggctgggagatgaggtgcacacagttgcagctaggtcggggccccagttaagctgtgccccaccaccctaggcaatgaggggcaggaaaggggtacagaatgaatggtgaaagagagtggagatacggaagggggagaggagaggagaaatgtggacagagggcttgaagacatggccgaataggctactgccacccggctttggggagatgggcgataagtgttgaggtaggctcgagaactgctccccaaatcagtgagaattgcattaggagccctctggggaaagagcacaggaactgagttgctgggcctcaaaacaaaaggctgcaggcacatggttagactgccgctgtctgaaggaccatatcttacagaaggtgcacatactcccaagggccactcttgccctggagatcttggccttggggccaaagacatttccatttccgatctccatggggaggagggacttaagcccaagtgggtcaggcctggcccaggtccttatactcccctatcttgtcctagcccaggcctccatgaaggagaacctggtggcattgccccagagctctccagagatgagcctcccctatccccaccctgtccccgtccccagcctaccaaagagtattcacacctttccatccctgactctatgggttactgtcccaattgcgaaacacccatactcctcttcaccctgtagcagggtcttctgctccagtcaccccggcctcttgcaagagaaagtccagggactggcaagaagaccctttgactaaagataatgtgctgtcatatcttggctgagaaactgttgagtcaggctagaggactggacaagagaagaggcattgagagcccccttgggagccattagccttgctctggtctgctgtgtggggttggggagtaggggggatcccacattgcctgggacatctgaatgctgatacgaatggacaggaaagggagccagagctgtatacctgggacaggccagggagcctttagtgccagcagggcctgtgtcctgggatgtgatgctagtgagtgaatgggagggcgggcctggagctgcgtgagagtgaaaccaagaagcggatggggaagggagagctggccttggtcagcttagggatgaatggagaaggaatcattcatgggcctcggctaggtcccagactgattacatgagactggggagtccttccctgccagttttctcatttattacagcctatcccccaaccctacccctgtgccctgcctacacactcccgtttggccctcagcactttgggcctggtcacataccccatccctagagtgctcttttcagctggggaggggaagaggtgctggctcctttccagacatgcttatgtataagtaaaggggcaggtgcttgggctccagagagaccctaggtactgccttctaactcctgcatcctcagaaggggaaaagggactgggaagtaaagggaaaccatatggccccagggaatggacccttggagactcccatcctctcttccccctcaccaagtgcccaggagacccctggctcagaccagcccaaggccttgcccagtggcaggggaaaggggcacctcactccacctcaaagtcatttgactgcccccatccaccccaccaccctaatcttccaccacctctccggctgcccctgccctccatcacagacagcagagccgggcagctttcttatgccattttctacactgtgcttcatgagtaggactttcttgcactagttcctatgactgagtctccaaactggtttcctagtagtcccccatcccttcctcccttacccagctatgattcagttgtctctgccctccctcttaccctgcctctgtgtttcggtgagagtctctgtatatgtactgctttctgttttgttgcattgtggggcagaggcctctctgctcttgtttaaccccataaagaaataaatggtaagacttgatgataa

SEQ ID NO: 5710 - DNA, 28062 bp, human
acagtaagagattatagcaaagcatctataatcaactcagcttaagaagttttgaccttctggttaggcttcttgccacaacagaacagcaccataaccatggctttcttctcccgactgaatctccaggagggcctccaaaccttctttgttttgcaatggatcccagtctatatatttttaggtgagtgaaccccaagggctggagagcacatggggaacaaaccaaaagagtggccaatctccagatgaggagggttccaaagagatcatctgggtgatctccaccctctgggaaggatctggctggcacaaaggccaggagtgaggctgcagctgttctggtttaaagattactccaggccaggcacggtggctcaggcctataatcccagcactttgggaggccgaggcaggtggatcacctgaggtcaggagtttgagaccagcctggccaacattgtgaaatctcgtctctactgaaaaaaaaaaaaatacaaaaattagccaggcatggtggcatgcactggtaatcccagctacttgggaggctgagacaggagaatcacttgaacccgggaggtggagcttgcagtgagccaagatcgtgccactgcactccagcctgggtgacagagcaagactccgtctcaagatgaaaaaaaaaaaaaaatcactccagtcttctcaggagctgtcccctatgaactagctgaaaagagtcatattcagggacagggcagaagtggtggtggcttacagagttggtgttactaggtaggtgtagggtgattttctagtctatggttatggtgagacaattctggaaaatctgagggctgcctgagtgacatctcagacagaattttgagaaagagccagttgttctgtggactcacagcacagaagtcaacaatgttgggcctctcccacccaaggctcttctgaggcagcttttttttgttgttgttgagatgaagtttcactcttgtcgcccaggctggagtgcaaacggcaaacgggctgacagctccaagattttccctgccagaaaccagggatttgggggtggtcaattacaggtgcaagcttgaaaactggatgaggagaaataatgtcatcctgaaggatgagacaggtaggagacagctggttccaacccatgggaggctatatgacccttagagcagaggctctcaaccagggtcctatagaccaaaaattcagggtggatgggggttactttgaattgggatgaataaaactgcctctttctttccactaacctctaactgaaatgtagtatttccttcaatgatgaatgtaggcaataaaccacgaagtgttaggagtacctgtgagtgtcagtaacagacatcacagagatttgcatttcatattatagttgttgcaggcatctcgaaatttcatttatgttcacgactacttcaaaattccagtagttattggcactgctgttagatctggttatttaatgcatacatcaagaagcacatatgttactatattatattgtgggtaatattttgataactgaattttaatataatgggtttcctttgtaaatctgcgtattttattttgtgcatttaaacatattattcagagaaagggtccatggcttcaccagactgccagaggggtccacagccttctcaaaatgcagacttattaagccttattaaaatcaaaacatgctaagcccattgatggcttgactttagctatatcgagagaagaaagtcattttgttagtaaacttagttgtttctagactttcatagtttccttttgttttcctttgcatttcccctaacttcctcaaaaagacccctttgataagttctgaccctcagccaggaaagtgaggagcacaggaatgtcctaagagacttgctattggggtggcagcaaccgtgtcaaatccgggtcccagaaagagtgggcagagatggggcagagagagcaggggaaagaggtcaagagaggatgagctatgtgagcgggtccttttaggtgtagggcctgtcccacccaagaatgctcttctgaggcagcttttttttttttttttttttttgagatggagtttcactcttgtcgcccaggctggagtgcaatggcaggatcttggctcactgctacctccgcctcccgagttcaagcgattctcctgcttcagcttcccgagtagccgggactacaggtgtgtgccaccacgcacagctaatttttgtatttttagtagagacggggtatcgccatgttagccaagctgttctcaaactgctgacctcaggtgatccgccgacctaggcctcccaaagtgctggctgggattaccggcatgagccaccgcgccgggccgaggcagtgtttctaattaaaatgtactcatttttctgccagaaaatgatactttctcatatatatttttctctatttcatttcccctctcaaaggacactgtgtcctgctgggtatagggtagagagtgtatcagacaactggatatgtgagggaccaagaaggtgaggattagcctccaagtaatgcccctttacccccaaatctcaacggtttctagttgtcccagaagagctggaggagtggagtggggatgatacctatgggtcttcagtggaaacacataagaataaatggggccaggtgcggtggctcacgcctgtaatcccagcactttgggaggccgaggcgggtggatcacaagatcaagagatcgagaccatcttggccaacatgatgaaaccccatctctactaaaaatagaaaaattagctgtgtgtggtggcgcgtgcctgtagtcctagctactcgggaggctgaggaaggagaatcacttgaacccgagaggcagaggttgcagtgagccaagattgcgccactgcactccagcctggtgacagagcaagactctgtctcaaacaaaaaaagtaaaaaataaaaaataaaaataaaaataaagaataaacgggattttttttcaccttcatttttaaaagttatttttattgtggtacaatacctagaacataaaatttaccgttttaaccatttctaagtatgctctaagtacatgtcattaagtacattcacaatgcatggccaccatccatctccagaattttatcttcccaaactgaaactctgtatccattacacaataactccctaattccccctccctccagcccctggcaaccaccattctgctttctgtctctatgaatttgcctattctaggtacctcatataattggaattattattccagtgtttgtcctttcatgattggcttattttacttagtataatggctttaaggctcaccatgtggtatcatgggtcagaatttatttcctttgaaaggctgagttatacggtgccttgtgtggatatgccacatattgttttccattcatctattgatggacatttaggttgccttgacgttttggctattgtgagtaatgttgctatgaacatagatgtacaaacatctctttgagactctgctttcaatgcttttgatatatacccagaaatggaattcctggatcacacagtaattctgtttttatttttattttttggaattgccatcctgttttcctcaatggctgcacaatttcacattcccaccaacagtgcacaagagtttcaatttctccacatcctcacctatacttcttattttctgttttttaaataatagccatcccaatgggtgtgagatgatctcattgtggttttgctttacatttccctgatgatcagtaatgttgagcatcttttcatgtgcctgttggccatttgatttgacttcttttagactgattagctttaccattccatttgtctttctcttctagtttaggtgctatacatcttgtttctgttcttttagtgattatgctagaaattacaacacaaatcctgggtcttgaaggttaccaaggtagcttcagtgtccaacagggcgtgatgcccacagaggtgcctaagacattcaaatatgttcaatccaacagttatagattaaatactaatgatatgatcttgggctgtccttgctgtgagatccttgcagcctccttactatctagtaacagagataaaccaatcattcattcaatcattgtccgcattttatgtgccagtgctggacatatacacagatcactataatgtaagacagactgtggtgagtgaaagagccatgacaaagtgatattagggtatcggaataagaaattattacataagttgaacagatcaggggagacaggaaagggaatcaccgtggaatggcaaacaggacatgagttctggagttcatcagacttagatggcaattagctatgtgactccaagcaagtactgcaatccctctaagtctcagtatccccatcctctcagtctggtccatgggaaatgctcctacagaaatgtctgccttcctcccttccttcctcctcttctttctcgcctatctttccttcctccttttctttctcaccttctttccttccttccttctatcttgctcagagcctccctcagtgcttcccctccttcccaaatgatgttcagaatcatagctgattactgagcattactggaagtaatggggaggaaatagagaaaatggaggaaaggcagagggacaagaaggaaggaggaagcaagaagagaggaacgagaaaatggcttggaggagatttggaacacaaatattcatgtccttaaaattaggctgtggctctgacagcccctctgagagccagctttcattcagaggatggctttccctcatctcttccgggcttgtatcaccatccccctaaactatctcaatatcctttttcctgatcgtctaacctctgatctccaccctctccaatctattccagtgcttacttctggaggtctttcaaaagcatcttttttttttttttttttttttttttttgagacggagtcttactctgttgcccaggctggagtgcagtggggcaatctcggctcactgcaacctctgcctcccgggttcaagcaattcacctgcctcagcctcctgagtagctgggattacaggtgtgtgccaccacacccagctaattttttgtttgtttgtttttgttttgaggcagagtctcgctctgtcgcccaggctggagtgcagtggcgcgatctcggctcactgcaagctccgcctcccgggctcacgccattctcctgcctcagcctcccgagtagctgggactacaggtgcccgccacgatgcccggctaagttttttgtatttttttagtacagatggggtttcaccgtgttagccaggatggtctcgatctcctgaccttgtgatccgcctgcctcggcctcccaaagtgctgggattacaggcgtgagccaccgcgcccgaccatttcttttgtatttttagtagagacagggttttgccacgttggccaggctggtctcgaactcctgacctcaggtgatctgccctcctcagcctcccaaagtgctgggattacaggcgtgagccaccgcctcaaaagcatatttgattacatccctctcctgctcaaaaatagtcagtggtttcccattgcctaagtgatgatgtataaaggtatcagactgggcattcaaagccctcctccattctctggtgttaaccccttgccagctcgtcctcctactcttccctacgtgattgccttgcgttccaggcaatctattcactaaacaaacaggaaatgtactctcccactccttcacctctgctcccactactcccactactcctgccagtggaaagatggcatgatagctcttcctggactatccagggacagcgcctccttttagatattactcaagtcatatcttctctgtaacattttccagacaacccaagactatatcgcctctgaaagtctagagcattttgtaagaatggctgggtagcagccattatatctttggtgccctctacccaataagctccatgagaacaggagccctttcttatcattattatatttcatgcaagaccaagcttgacactaacttgaaggtcttccagatttcttcttcctcagcagaaatctttaaattcactcttattcttttttctctcccttggacatcctttttgggtgtgtgggcctgccctctttctctggtttctggtactgtaaaaaatagaacaggttgggtgcagtggctcatgcctgtaatccaaatatttttggaggccgaggtgggaggatcgctcgagcctgggagtttgagaccagcttgggcaacacagtgagactccatctctacagaaaaaaaaaaaaatcaaaaaattagccaggcatggtggtgcatgcctgtggtcctagctattgtgcaggctgaaatggggggctcctttgagcctaagaggtaaaggttagagtgagttgtgatcacgctattgcactctagcctgggtgacagagtgagatcctgtctcaaaataaataaataaaaatagaacatagtcttcagaccagttctgtcacttacttgctatgagaccttatgcaagtgagtctctgttattttctatgtgaccttgagcaagtaagtcattcaccctgtaccataacagaaacagcatagtacctgcctctcaagactgttccagagatctttgaggtgagaaaatcctcaatacatgttaattttcttccttttaactaccgaaattgactacttggagcccaaccaccacacctgataagatactaccaaccttgtcaatcttgccacttgatcaagagaggagtgacaaccactcctctgaggcagacaccttagacactgactttattacatcttcaggaagaataatgataactaaagcagatacaggctttttctttttcttattttctttctttttttttggagacagagtcttgctctgtctcccaggctgaggctggagtgcagtggtatgatcataactcactgcagcctcgaactcctgggttcaagcgatcctcttgcctcagcttcccgagtatctgggactacaagtgtgcaccaccatgcttggttaatttttaaatttttttgtagagacgaggtctcactatgttgcctgggttggtctcgaactcctggactccagggatcctcctgccctggcctcccaaaatgctggcattacaggagtgagccaccatgcctggcctagactttgatgcattcccagcattcccacataccccatcacggcatctttcattaatccccttccatcaccccagcatcaactcagctgcgttgggctgaaaaattctacctccttggtgactttcaaattggtatgtgaaatagtagcctatttcaggttcccattggctttcatctgaatgccaaaactcttagctgatctctttgcctatagtttctcttgctctcacagttattccagattatcttcctgaaacagacacgatcatgctactcttctgctctctgcttactaacctttactggctattcatttccttcagcatcaggcctaatctctccagtttccttcccagcttcatctcctgtaccacggcttccttaggctgcctgtgtttttgcaggtaatgatgttactcccaggccttggactctcccatctcctggactttgttcaggctcttctttgtgcatggaggacccttcctctaccaatccatctgacaaaaatcctacctttcctccaaaattcaactttgaaccttatctttcacaagaaacccagagcttctccaagacaggaattttgttttccacacgtattaatgtgagttaatacacatgaggtacttaaaatagttattggcacataatgaatgctatctactttttttcctacagcttggagtaaagatacatgatctctctgattcttagtttcttcatctgtaaaacgagataataaaattatccacctatgaggactgcaagaacattaaatgagataatatacattaagtgctgaacagagtgctgtttcacaacaaatggtcaatacatggtatcaaggaccatgcttgcattattttcatcatttccatatttactcctttcaccctcccctttccagttcccaaccctgtccccatggcttttaacatagagatttcatatgaggtaggctcatcaatgtttactgaattattaaattacctgtcactcctacaagttcttatatttatagtttatttggatccaacaagtaatcacaaagccacagaaattcctctttgacaaactacttttgttttttttttgttttgtttttttgttttttttttttaaatttctgaaggcattgagccaactgactagattaggcaagcattgccaacattcagatttaggtcattgccccgaaacatgaaacataatgttttcacccataagaattataggttttcaccttacactggaaataactcgttgcctatatccttacacacacatgcacaccttataacttcagatagcctttccttgtttggaatacggtttctcttcctattaactttcacctgcaacttggagaattgtgaaattgaacttcttcctttactataattcaatgtaatgaacatttatcataagctatctctctgtgtttggcactgtgctaaaggccaaacttactgtctgatagggagagagacagacatatgaggtactaattacaccatcaaacaaaatgaaccagaaccagaaagaagcacgagtaatgtcttgggagtgtgcagaagagggagtcctcaattctgaccgggagatgagcaaagatatcacaaggaagtgtcatttgagctaaaccataaagcctgagagaattttgataagcagaaagttggaaagagagtaataaaaataagggaacagtatcatcaaaggcacagaaatgtgaattacatggtgagttgagggaatgggaagtagacaaaggtggtcgggcccgtttcccatactttagccatttgtgtcccatcttctggctctttccacagctgtgtaccacctatgctattattacttaacatacttttccttcaaattaagtcatctctgtagcctaaattaatgtattttaacaggaaattttatatcgctaccatgaatttgcttttattctctatgcattaaaataactttttatccatacaccaccttggatcatctaatgtccctacagggcatgggaacactaggctacgaaacactttgagaaatactaggctgcagcataaggaatgtgagtacggctactgagagatgaggctaggaagacacgtggggctaggccagtgagggccttgaataccaagccaatgtgttcagactttattctgtcagcagttggaaaatattgatggttttggaggaagcaaacaacattatgtgattgtgctttttaaaaatttctggcagaggtgtgggaaatggattggaggggaagaaacccatagctgaagggcagacaaaaggctgcagtccagactagaaaaaaatcaagtcctggaccatagcagtagcaatggggacagaggcaggaagacggataggagaagttttttgtttgtttgtttgtttgtttgtttgtttgtttggaaagggaaagaagtcaaagatggcctaaaaatattgaacctatgacatttatcttgaggcctgaaagatgaataggaactagccagacacagagctgaagagagagttttccaggcaaaggggaccgcaggcagagaagccctgaagctagagagcacttgaaggagctgaaaaaaatagcatggtggaatgcaaagaacaaggtggtggccagagactagatcaccaagatctcctaacccttctaagccagggttaggagactggacttgatcctaagggccacaggaaaccatatttattgttgaattgttaaattaccatatactcccacaggttcttatatttatagttaacttagatacagtaagtaatcataaagccacagatatgcctctttgataaaccagccatgtccttggctacatgctatagattgatagagacagacttgcatttaatgcactggctgcatcatggctcaaatggaagcaggcagcctatttagaagacactggtagtcatccaggtgagagataatggtggctttgaccaagtggtagcatggaggtgggaaatagaataatttgaaagatatctggaaggcagaactggcaagaattggtaaatgactaaagggaagtaacagctagagcttagtggttaagggtacagtctctggggtaagacaatcttggttttcagccctggccactcacctgctagctgtctaatcttggaacaatgtaatcactctgaacctcaggtcctcatccacaaaatgataatgattactgttctcatggggtctttatgaagattaaataaactatgccatgtgaaacagttttacatgataagtgtacaatagatattggctattaatctatgggctaagtgagcaagtgagaggaatcagagatgatttgaagaaaggacccacttaggtcatattggtaccatttttaacttaagctagtaatcattagcaatttgaggctgtacaggtttaactttttttaaagtcaggatcagggataaagagtgacattatgtaatgataaatgggctgattcaccaagaaaacaactatcctaaatgtgcatgcatcaaatgatagaactgcaaaatatatgatgcaaaaactgatggtgctgaaaagaaaaatagacaaattagcaattatatttggagacctccttgacaactacaatcaatcaaaactcacctaacatgaaataaataacccatcactataatcttaattttagaaggttagaaaccttccaaaaagagattttcagacccagatggtttcaacagcaaattctacaaacattttacagaaaaaatatcacgaattctatgcaatctctgcaagaaagcttaagagaaaggaacatttcccaactcatttacgaggccacatcctgataccaaaatcagacaaagatagtacaaaaaaggaaaagaaaactacagactaagatccctcatatatataaatgaaaaaagcaacaaaatattaacaaattgaatccagcaatacattacaaagagtaatgcaccatgaccaagtggcctttatccaggaaggcaagtgtaaatatttgaaaataaatcaatgtaaactaccatactaaccatctaagcatgaaaaaaccccatgtaatcatatcaattgacaaacttcaacatgtaatcatgataaaatctctcagcaaactaggaatagaagggaacttcctcaacctgataaagggcatctacaaaaaaaaaaaaaaaaaaaccctacagttaacatcacacttgatcatgaaagatgaaatgctttctccctaagattagaaacaaagcaaggatgtccactctcaccacttgtattcaacggtatgctaaaagccctagcaaatgcaatatggcaaaaagaaaaaaagaaataaatgcatacagatcggaaaaaaagagaaataaaactgtccttacttgtagatgacatgatagtatgtatggaaaatcccaaggactctactttaaataaaacaaaaacctccaagcactaacaaatgagattagccagtcacaggatacaagatcatgcataaaaattaatcacatttctatatactagcagagaagaattgaaaatagaaattttaaaaaaaataccatttaaataccttcaaaaataaaatgtttgggaataaatctagtaaaccatacaggattcataggctaaaaactgtaaaatgctgatgaataaaataaaagatctaaataattagagacataccatgttcacagattggaagattcaacacagtaaagatgccaattctccccagattgatctataagtataatgcaattcaagtaaaaatcacagtcaggctatattaggtaatagtttcgcataaatattaaatttcccaaatttggtaatagcattgtgggtgctataagggaagagaatatcgtttttcttgcaaaatacacgctaaaaactatttagaagcaaaaggttgtaatctctgtgatgtattctcaaatacaaacatatatgtatatacttacatttttacatttaaagataaatcaaacgtaaaatgttgacaatgggtagatgtagatgaagattaaacaagactttattaaaataatcttgttttttcaaaataaaaagtttaattaaaaaacctccatcaagagtttttgtagcaataaacaagctgattcaaaaatttatatagaaaaacaaagaaactacaaataattaaaacaattttgagaacgaataaagttaaaggaattataccatctgattttgagacttagtataagactagagcaatcaagacagtgatgtatttgtgaaggaatagatatattgatccacagaacagaaaagagtcaagaaataaacacatgaatatggtcaattgatttttgacaaagatgaaaaagcaattccatggaggatgaataagtcttttcaaggaacggtgtaggaaaatttgatgtccatatgtggcaaaatgaatcttgacccaaacttcaggctctataaaaattaactcaagtatgacatcaacaagatggtgaatgggaagtccatcacatctctccagagcaacaagaatctggcagccatccatggaccaaagtacctttgtgggaattttggacccaggtaggatgttgcaaaactctagtagagtccaacaccaaggaaggctgttttgagagggcaggcccacacccaggcttgttgactgtggtgaaggttacagacctggaaatagcctcatccccctgtaaactcagctacaatgccatttggtcatgattctgccaccaaaatcatcttccaaggcatccaggaggagtcacaaccatctgtgcctcaagttacaggactgccaatcttggtcccagcagtataccctgaagcagccttataactcagctctggtcacactctgctgtggtatgggagcaattatgccttcccaggggcttgctgggagtcatgcctgtctgtgccataggaagcaagcttgctaaccttggtatcacagcagatcctgaaacagccctgtaacttgggtccagctccattcaactgtacagggcagtcctgtccacccaggaacctggcaggaggcacacctgtccatgcccatggaggcaggcccgcaggcctcagtcttggctatagaccttgaggcagttctatgacttggttctagcccttctcagccacagtcccgggcctgtcctgcctgcccagggacccacccagtgacctagcagaagcccccccataaacctgctgaaatcactctataaagactgatttgctccttcaaatgcacagaaaccagtgaaaggctatacaaataacaaataatccagcaaacatgacatcatggaagaaaactagtataattccagtaacagcccaaataaatggagatctattaaaggcttgaagaagaattcaagataatcatcctgaagtgcagtgagttgtaagagaacacagacaactgaacaaaatcagaaaaacaacacataaatgagatgagaagtttaataaagaaataaaaaccacaaaaaggacccaaacagaaatcctggagctgatgtatacaatgacagaactgaaaactaaaagaaagagtttcaatagcagacttgatcatgcagaagaaagaaatgggtaacacaaagataggtaatttgaaattagccaattagagaaacaaaaaaagaaaaaaaatgaaaatgagtgaagaaagcataaggaacctatgggacacaataagcaaatgaatctactaattatgggtgtcccataatttaggagaagaaaaagagagagaaagaaacagaaagattatttcaagaaataatggttggaaacttcacaaatcctaggaaagaaatggacatcaagattcatgaagctcagaggatcccaagcaagatcaactcaaagaagaatatcctgaagcacattataatcaaattgtcaaaagtcaaagacaacagagaatattgaaagcattaagagaaaagagtctcaccacatacaagggaacctcatcagcaaacttctcagcagaaatcttgcaggccaggagggagtgggatgatacattcaaagtgctaaaagatgaaaaaactgccaatgaagaatactataaccagcaaagtggtcattcataaatgaaggaacaataaagacattctcaaagccaggcatggtggctcatgtctgtaatcccagcatgttgggaggctgaggtgggaggattgcttgaggccagtttgagaccagctggggcaacatagtgagactctgtctctacaaaaataaaaataataaaattacccaggcatggtgatgtccagctacttggacttccagctacttgggaagctaaggcaagaagatcgcttgagcccaggagttcaaacttcagtgagctatgagcatgccactgcacttcagcataggtgacaaaatgagaccccatctctaacaacaagaaaaaaagacatttccagacaaataaaagataaaggatttcatcacgactagacctaccttacaagaaatgctaaagaaaggtgtttaagttgaaatgaaaggatactaaataacaacattaaaacatataaaaatatgaaactcactggtaaaggtaaatatatcatcaaatccaaaatactcagaatactgcaatggtagtgtgtaaatcacttttaactttatatctttttatatcatgtatccattaacaaattattgtagctgtagttatttttagtactttcgtcacttatgttagagttaaaagtggaaatcaaaaagtatcttgaggcaaatgaaaatggaaacacatcataccaaaacttatagaatgcagcaaaaacagttctaaggggaaagtttatcatgataaatacctacataaagaaaaaaggaatgtcacaaatcaataacctaactttacatcccatgaaactagaaaaaaaagaataaaataaccctaagataaacaaaagtaacaaacccttagctaaactaaccaaggaaaaaagagacacaatatcaaataaataaaatcagaaataaaagagaagacattacacctgatgacacagaaatataaaggtcataaaagactaccatgaacaatcatatgccaacaaattggataacctagaagaaatgcatatgtttctagacacatacaacctaccaagaataaattatgaaggaagaaaatctaaacagatcaatgacaaatgaaatttaatcgataatcaaaaacctcctaacaaagaaaagcccaggaccagacagcttcctaggtggtcagtagttcaagaccagctcggccaacatggtgagtttgagaccagcctggccaacatgctgaaaatacaaaaattagccaggcatggtggcgtgctcctgtagtcccagctactcgggaggctgaggcacgagaattgcttgaaccagggagcagtgagccgagatcgcgccattgcactccagcctgggcaacagagtgaaagtgtgtgtcaaaagaaaaaaaaaaaaaaggattaatgtcaatccttctccaactcttccagaaaactgaaaaggcaggagcacttccaaactccttttacaatgcaagcactaccctgataccaaagctaggcaaggatagtcccagaaaagaacattacaggcccatatccctgatgaacatagatgcaaaaaatcctcaacaaaatactagcaaaccaaattcaacagcacattaaaaggagcgtacaccacgatcaagtgggatttatccctgggatgcaggggtggttcaacatgcatatgtcaataaatgtaatataccacattaagagaagaagaataaaaatcataagatcatctcaataggtgcagaaaaagcatttgacaaaatttaacatctttccatgataaaaactctcagcaaattagacatagaaggaatggatctcaacataataaaggccatatatgaaaagtccacagctaacatcatacacaatggtgaaaagctgaaagcttttcctctaagattagaaacaaggcaagggtgctcattctgccatttctattcaacacagtactggatgtcctaccaagagcaattacacaagaaaaagaaataaaaggcatctaaattggaaagaaaaaagttaaattgtctctgttagcagatgacataatcttatatagaaaaccctaaagcctccaccaaaaaattgttagaactaatagatgaattcagtaaagtgtcaggatataaaatgaacatacaaaaatcagttgcatttctatacactgacaataaactatccaaaaaagaaatgaaggaaaacaattcaatttacaatatcactaaaaggaataaaatacttaggaataaatttaacctaggaggtgagagatctgtataccaaaaactgtaagacattgaaaaaaatcgaagaagccacaaataagttgaaagatatcctgtgttcatggactggaaaaattaacattattaacatgtctatactactcaaagtgagctatagatccaatacaatccctatgaaaattccaatgacatttttaaaagaaacataaaaaaatcctaaaatttgtatgagacaacaaaagaccctgaatagccaaagtaatcttgagaaagaaaaacaaagctagaggcatcacacttcctgatttcaaactatattacaaagccatagtaatcaaaacactatggtactgacataaaaacagacacagaaaccaatgaaataagatagatagcccagaaataatcccatgcatttatagtcaactaatctttgaaatgggtcccaagaatacacaatgggaaaaggatagtttcttcaataaatggtgttgaactagacatcctcatgcaaaataatgaaactagactcttaccttatgacatacacaaacattaactcaaaatggattaaagacttaaatgtaagacctgaaatcactaaactcctaaaagaaaatatagggaaaaagctccttgacattggccttgacaatgattttttggatatgacaacaaaagcacaggcaacaaaagcaaaaataaacaagcaggagtacctcaaactaaaaatcttctgcctagccaaggaaacaatcaacaaaatgaaaaggcaacccacagaatggaagaaaatatttgcaaaccatatctcttataaggggttaatctctaaaatatataaagaactcataccactcaatagaaaaaaataaaataacataaactttttaataggcaaaggacttgaatagacatttttccaaagaaaacatacaaatagccaaagggtatatgaaaaggggctcaacattattagtcatcagggagctgcaaatcaaaaccacagtgagatatcaccttacacctgttaggatagctattatcaaaaagacaaatggtaagttttggtgaggatatagataaaagggaatctttgtacactgttggtaggtatgtaaattgttacaaccagtatggaaaatagtggggagtttccaacagtaatgaaattagtgtcttgaagaaatatctgcacccccatgttcactgcagtattattagtaatagccaagacgtgggatcgacctaagtgtccactggcagatgaatgaataaagaaagtgtcacacacacacacacacacacacgaatattattcagccataaaaaggagatcctgccatttgcaataacatggatgaaccaggaggatactatgctaagtgaaataagctagacacagaaagaaaaataccatatgatctcattagagctggatgtggtgtcacatgtttgtaatcctagctactcaggaggctgaggtgggagcatcacttcagctcaggaatttgagaccagcttgggcagcacagagagaagctgtctctaaatatatatatttgtaaataaatgtaaattaaattcatagaagcagagaatagaatggtggctgccaggagctggggcagagggaaaataaggaaaaatttgtcaaagggcacaaaatttcagttacaaaaagaataatttctgggaatctaaagtatagcagcattaataatactgtattatatgcttgaaatttgctgagtggatcttaagtatcctcacctctagccacaaacacacacaaagggtaactatgtatggtggtgaatgtattgattaatttgattgttgtaatcatcacacaatgtatacctgtctcaaatcatcacattgtgcacattgaatatacaccatttttatttgtaaattatacctccataaaactggtaaaaatgaacttgaagtgtattgtagatctaaatgtaaaaaaagaaaactgtaaaatgtttagtagaaaacacaggggaggtcaggggcagtggctcacacctgtaatcccagcactttgggaggctaaggcaggaggaccacttgagacctggagtttgaaactagccagggcaacatagcaagaccctgtctctacaaaaaaatacaaaataaattggctgggtgtggtggcatgctcctgtagtcccagccactctggaggctgaagtggggggatcgcttgagcccaggaagcggaggttgcagtgagttgagccgagatcacgccatggaacgccagtctgggtgacagaaccagatcctgtctcaaaaaaaaaaaaaaaagaaagaaaaaagaaaaaaaaagaaaaaagaaagaaagaaaagaaaagaaaatataggggaaaaatcttcatgacatgaggttagacaaagagttctttcagtttgacaccaaaagcacaatctataaaagaaaaaaaattaataagttgggcttcatcaatattaaaagcttttgctgtaaaaaggaccctgttaacaagaatgaaaagatagacacagattaggagaaaatgtttgcaaatcacatatcagacaaaaaaacttatatccaaaatgcataaagaactaccgaaagtcaacagtaagaaaacaacccaattgaaaaatgggcaaaagatttgaatggacacttcaccaaagaggatatacagaaagcagacaagcacatgaaaagctgttacgcatcactagctattggagaaatgcaagttaaaattatgatgagctaccaatgcgcatatattagtttttttttcttctttttttttcttttcttttcccccagtgcacatatattagaatggcttggccatcttcactacaaactaaattaggagcctacctatgtgaacttcctctttgataaccctctccaagacgcctcacttgaacgtgacaagagaaattggaaccatcttctggtgtcaaggccataatacctaagggagtgtcacacatacataaatgcttgttcttcatcattccttcttcagatacccttgctttatgtcacggaactctttttacatgagacttagctcttccacatttggcttctatttctcctatatctttaaattccacttttgttaccgtgcacgacactgatgacactcgggctgggtctggaagccttgctctgaaaaaaacgttcctcgtctcctgccgggtcatatctgcagttccaataggttccacaagggggatggtgttacccaggtaagggctcttagaccgcctttaggactggtggatgaatgaatcagataaaaggcacacaactaatccgtctatgcttttaaaataacatcacatttaaataacactatacatgctgactaaatagtaattatcaagtttactactgaaaagagaaaacatttgcttatttcgttttcaattggtctacagatatttgttgaacacctactgtgtgccaagctctcttctaaatactggggaaacaaacaaaatttatttgaaacaaaatataaaagaaatgatacacttaggctaactttaattagtgattattcttatttaactttatctgaatttccttctgaagcttaactggcaaatttactctcctctttgatgaagggcatagatagcaaggctttttctccatggcaggcttcccataaaactcctcccaccacgctttcctgtctaatttgaatgcttacaacaactatctcgaccagtgcttatgagggcaattcagcctattacaaaggtttcttctactccataacatgactttttaaagcactgtccactcagcctttttcctgctattttcatttatgtccaaaatgcaagagacaaagaactggtaggtaactcccgagtttcttcttccctgaaacttttatctgctatgacatggtacctggtcaaagaagtcattcccttagctaagtctttttttattcaccatatgtatacttagcccctctttctcatgaatgcagattttttaaatggaattcattcgcactgctgtaacatgtatcgtgtttgcagttacagcctgctatggccatttgctaacacagacttccccttctgaacctttgtgatacttttgaatggaacaaaatgaacacagtaaagtgttttttgttgttgttgttttgttttttgtttttttggttttttagagatactgtcttgctttgttgcccaggctggtctcaaactcctaggttcaagctgtcctctcactttggcctcccaaattgctaagattataggagtgagccaccgcacctggcctagtagggcagttttgttgttgttgttgttgtttgttttgttttgttttgttttttcaagacggagtcttgctctgttgcccaggctggagtgcaatggcacgatctcagctcactgcaacctccacctcctgggttcaagcgattctcctgcctccacctcccgagtagcactccaatcatgtgccaccatgcccggctaattttttgtatctttagtagagatggggtttcaccgtgttagccaggatggtctcgatctcctgacctcgtgatctgcctgcctcggcctcccaaagtggagtggtttttaatccgtgtttacttttcagcatcaaacagcctgtacactgcgggtaacctccctgctggaatatgcagacttatcagttcagcacaggaaagagggtcaagcttttagaaagaatttccagaggtcccagaatggggattcagctaccagcccaatgtgctcttcttcccattcaccaagccgtgctgtcctttgacctcaacttcatggttctgctctttcttcaattgagagtttggccatcaaggagacccagatccaggggcttcagaggcctgcctagaccacagcagagacaaatggagggcgaggggttggggaagaggggagaaggagagaagagtcccacatcagcctagccctgctcctgtagtgtagagcagaggccggggttatgagaagtatactaaaacttgaagggaactgaaaggcttgaaccctttgtgtctccccaggagctattcccattctccttataccctactttctgttattcagtaagttctggcccttggctgtgctctccttagcctggctcacctatgattggaacacccacagtcaaggtaagagacaggggcacaatggtggtcctgtttgggccaagaatggaaggacagggagagggaggtggagggagagggggagaaccaagggtaggggagaggggaaggaaggggagggagaagggagagcaaagctcagcagggacagaggtctctaccaggtagctcaggaagaattatgaggttgaggtctctgggcaggtgcccccagcttcagactattttcctgtcacctttctggtcggctctagaggagcaggggcttcctatgtcttggggattggattcagggacagtacttacagttctgaggtgtcagaaggaggcccctcacgtgacctgaggactgcaggcagaactctcctcctctgggagaggtagagggactgcaatgccctgtgtactcttcccttcccttctgtacccacaggtggcaggcgttcagcttgggtacgaaactggaccctatggaagtatttccgaaattacttcccagtaaaggtgaccactcttcctcggggtgccctcagtccctgttgcccagacccttgctccctactcagctccatgttttcagaggctttggtggtcagcagcgaaggtcaaggccccgagtcataatgcaaagcaagggcccaagatggatgggcaggtggggaaacaggtggatggcagcctttccttcactggcaaacccaggtcagcctctctgaccatcgtgagccctggcaatcctatgacaatgatgacaacctagtgaacagggatttggggctcccagagggaaacataggctacctgctgggattttagtccacacgtggtttcttccttctttgtagccaatgctctgactcaatttccctctaacagctggtgaagactcatgatctttctcccaaacacaactacatcattgccaatcacccccatggcattctctcttttggtgtcttcatcaactttgccactgaggccactggcattgctcggattttcccatccatcactccctttgtagggaccttagaaaggatattttggatcccaattgtgcgagaatatgtgatgtcaatgggtgagtataagaaataattaattctatttttttacctacttcaaaggtgcaaccccaataagtcctgacaatcactacctgcttgaagagtacatgatagaaaataagtccaggacaccctgggcccgtaacaggagtatgtggctaagcattagtttctgtccaagatctagggagcagggtttgattgggcagcaggggaaattataggcattcataggagtcaccaggacttttttcagagggagaaccagaaggctggaattcaggaccaatgccaaagtgcaaatcgaggatgaaagccaagaattaaacacaaatccagggaaaagcaggtgtgaatgggatagctcaggcgaacttcaccaggctctctctaggatgtcagctggcctctttgggccggtcatttgtacaccatggtgtcttaaaaacattttgaagtctatcatactagctaaaaccctcctggtccatgacttttatctccctggaaccccttcacacttgcataaaatactaagggataaaggataggagttcatcagagtatccagaacaacttccccatgctcagcttcaagtcagggcactgtgacaaatgtctctctctctggacaaatagtcatccttctggacaccagaaaacaactgaagccaaacatccaaaggtaagatacatttctgtggaggggccaggtgggaccactagagtcccagaggatgcttctactctgctctgaggttagcatggccctggagcaggaatacttctcaatggctagagtctggaggcaatttctgccatcacagtagacaatagaaggtgagcgcagggcaaagatgggagacagaagtgagaaaggctagatgattgttgttaaacaacagggtgtcattcacattccattattcatctacgtttcagtttggcttggtcaggctcaggggtctgcctactctccagaaaccccagccattggcttccctttggcaggttactcttagggaggaagcaggttggtggtggctagtctcgattacccctggaggagagaactctggaggatctccagtgttgtcaggctgggcagagtggaagatggctgtgcttcatgggtagagagggatgaggtgggcttagatactattgatctgaaatgcagtaggctatggatggtaggaggcagaggagctcagtatagacccaactgcagaagcacagacccccaaggcaaacagctgaccctaaggaccaatcttaggctagggcagtcataacccgggacacgaaggtcagagacagaaaggtggaaacagcaatagtcagaaaacagaagaactgtctccaaaaggaagagcctgggaaaaccccttaccccatcctcaggaatgaagtttttctaccacttgactctttggtttcacaggtgtgtgccctgtgagtagctcagccttgaagtacttgctgacccagaaaggctcaggcaatgccgtggttattgtggtgggtggagctgctgaagctctcttgtgccgaccaggagcctccactctcttcctcaagcagcgtaaaggttttgtgaagatggcactgcaaacagggtgggttccaaggttctagtgctctgttgtcagggtgccataggccctctgtagccctctccagaatggtgccctccctgggcacctgttagagggcccccatcttcactctaattccttctgtctaccccctcacattgtgccttagggatgtttgggcctccagatacatttcagtgggcacttttcttacttgaagttggagaaagaacagcagaagaaaaccttttactttctgcccattggcctggtaggctggaggtctgggaaagcggggcttcactctatatcaacctgttaactgagaggccctaagaatctaccaactgcaagggaggcactagctttgataccgtgaggatcaaaaagataagacatgaccccaaagagcatacaatctggtttgagaaatagaccttattcattcagcagttacggaacacccactgtatatcaggcatagtactaggcatttaggatataaaagtaaataagacctggtccttgcaaactcacagtccaatatggaagaagacagacccatgcacatataattaccaaatacctgcagaatccaaccacttactacctaggctaccaccccttggtttactaccaccatctctccccttggttgattacaacacttctaactgctcttcctgtatctattcccacctcccccaccccaagagtctattcccagcttcagccaggatgatcctgttaaacatgagtcagatcatgtcacttctcaaaataatccaatggctcccatgtcactcagagtaaaagccaaagtctttataggggcttgcaagacgcggaataatctggtctatagctgcctctctgtcctcatcactcacttctcttcccactctctcactccatcatagctataccggcctctttgcggtccctcaagcaggccacccgctcctgctttagagtctttgctttagcggttcccttggaacactattcctccaaatgactgcttggctcattcctttatctccttcaagtctttgctcaaatgtctcttctcaatacagttatctgaccatcttgctctattttttgccggttacacttatcttcttatagctcatccattttatttatttgtttaccaactattttcaatgtttattgtctgtcttcctcccagaaaaagtaaactccacgaacacagaatttttaaaaatccattgtattcactgatgcatctccagggcctaaaacagtgctggcacatagaaagagcttaatatttgttaaataaatggaacactacaatggaaatgtgtacaaagtgccacgtgagcaccaatttatggaaagatcttgacccagaatagaggtttcataggtgggtaacatctgaactgtgaattgaaatattggtaggagttgccaggcagaccaaaagggagaaagaactcaggcattcagtgaggacctatggcatgtcaagtgctatgccagggcctagggattcaaagatgaatatgacccagttcttgcctttgattggcttgctgtctactgggggagtcaggcaagtaaggagatgactataatacacggttggggcagcgttagtgtagaagagaggtaagcactagatgaggggtacctaatccgcgttgggggaaatgaagtggtcaaacaaagttgctttaaggggatgagattgggactgagtgcaaaattgaatgagccacataaagacagagggaagaaggaagatacttccgacagagggagcagaatgtacaaagacacagagatgagagagtatgaggcacacttaatatggctaagcagattgcaaggaaagagtggggaaagggaaagctagccaaggagggaaggctagagcaaaaaggccgtaaggaagcagcatggtgcaaactgaggagctctggaagagtttgagaggagtggcatgtccagatatgcagtttacgaagaacactctgcatgctggatgcaatgaagacagagcttttgagattagtttctccctataacaggacaaggcagagcagcagctcccttcagagttcagttgggagagtgaggcatggcaggaatgggacatgaagatggagatgtttgggtgcttgggttcttgtcctataatggggaggttggagaggtttcccaccttggagaggatttttccggggatcttcctcagagagctcacactcctgcccctctctttgcagggcataccttgtcccttcatattcctttggtgagaacgaagttttcaatcaggagaccttccctgagggcacgtggttaaggttgttccaaaaaaccttccaggacacattcaaaaaaatcctgggactaaatttctgtaccttccatggccggggcttcactcgcggatcctggggcttcctgcctttcaatcggcccattaccactgttggtgagctttcccttatctccggatgacctgtttcttcattcacttcccacccactttaaatcatccatcaagtccagggggacccaactcacatctgggatgggcaatgggtgtggttaagagcagggtgggtaggacaactaaacagataagagttgtggccattcatggatgtgacatcagcatctgctacaagagcatcaccattcgcacacattctgtcaccactctcctgagcttgcttgcattctcttgagcatgggtttgattagatgatcagagaacaggggccaggatgagactggagcaaagggaaagaaagaaagaaggggaggaaagccagatactgagtttcagtacatggctcccagtgagggatgagtagtttgagttgaggggggaactctgatgtttgtctcttttcttttttcatagttggggaaccccttccaattcccaggattaagaggccaaaccagaagacagtagacaagtatcacgcactctacatcagtgccctgcgcaagctctttgaccaacacaaagttgaatatggcctccctgagacccaagagctgacaattacataacaggagccacattccccattgatcaacccccaaagccatgagggatccaagtagagccacagaaaaagaagaattccaggagagggaaagatcgtaaggatgagagaggagaccatccaagccagaaattatttaataaatcagagttctagcaatagagtcctctcccaagtggctgaggcaggcttaggggaaagaaccagaggggcaggggaggactggggagggctggctagccagaggagttggctgtatcacccctggttattttagggcaacaacccagttggggagtcttatgaatcattccagccaactctctgatcacaaagaatactgtgcccctttctcctaaaccttagttcaccatcactacgtaggtttagacttagaagctttatttggaacagggatagtttgtttcctcttggtcctttcc

SEQ ID NO: 5711 - DNA, 125433 bp, human
ggcagtccgcactgcaattggttggcgtctccgggacggatttgaaacttggcggttaaagctccggctgggacagggcggcgggaggcccagggagaacggggaagggacatttagtttggtgagttacgggggcacaccttagctcagaacctgtttttacccagtaccctagggctttggttctttgtcgccgtccccgttggagttttttctttgcctttcagaagcccgtgcactctctttagagtgcagggctgacgggcggtccagccctggccaagtcatggagcgtgaatctcccaagtcagtgttcccgctgaggagggtcggaaccggggaggacgccctcccacccctgctgacctactaacattcatcagcgagccttctttttccccctcgcagagacggtgctgagataggatcatgaaggaagaggtgaagggaattcccgtaagagtggcgctgcgttgtcgccctctggtccccaaagagattagcgagggctgccagatgtgcctttccttcgtgcccggagagcctcaggtgcgtagcagagtccagagcctgtgtctgaacagctggggccaaatggtaacgaggggtgtggtcttgcctttcatttttaaccttacgccttgtcccgtgccttctctaggtggtggttggtacagataaatccttcacctacgattttgtatttgatccctctactgaacaggaagaagtcttcaatacagcagtagcgccactcataaaaggtgtatttaaaggtaaggcgatttgattcctcgaacgtaacatatatattccttgagcatatactatgtgccaagcactgtgcttgggcactgcaaatacaggaatcgatgaatcatgattcctgccttcaagaagcccttagcctaataacatttgtcaacgtctctgtacccttgaagctagttttattctgtatttgctttatgtggttctgttcatctttgacttgtatatgtttgtttatcctggaacttcattagattataaactctgtggtggttgctgatggtgataagtgtgccaacctacttgaggcccaggcactgcaaagcttgttgagggattcaggtgataaataatatagcttcgaggccctgaaggagttcaaagtccaggggataggaatggagatagatgactacataaataattttgaatatataaaaatttttaaattttttgtacctatcttttagaagaaaaatttttcaagttaaaaatatacaacagagtcagtcctatggaagtagtagctctgctctcatacaaagtggtatgaaaaacaaaaggatggctctaactctgcttggggaatttggggtgaatttcacagagtgggaaaactttgagatgggtcttgaataatgagtatacttcttttaggtggagaaggggagtgcctaaagcctctgaatactatcaccagttaataatctttactggggaagctaagtctttaatgctgttgaggaccatagcagggttctaaagaagggagcagtgcctgagagatgtctaattattattctaatacagtggttattcaagattcaaaacagaggttcgtttaaaagaagtagaatcatggcatgctagtgccttaaagttgaaagagacatttgtatatcatctagtttgtttttcatccaaagaaaaatgcgttctaacaatatctgttaggtgaactgccagtgtctaaaatttttttgacagggaactcactgactcacaggtagtccagttgagatttgggttttggacaagtctaattatgttataaagatctttataatgagatgaaatttgcttcctggtaatttctacccagtgatgttagttcattcctttagaagccttcttctaggcaacagctattcacatattttttcacgtttttttgtttaatgatatggctcaaggaacactgaaatttttgtttcaaaattttaagatattaatgcaataatttcaaacgtatagaatgttgcaagaacagcataaaaaacattttttccctgaaccatttgagatgaatcattggcctgataaccccccatactttagtgtatatttcctacaaaaaaggactttcttctaagttaccacaatacaaccatcaaaacaataaaatttgcactgctacattactaccatctattcctgaaaccccattcaagtttcaccaattgtcccagtaaatattttatggcaaaaagatctagttcaaaatcacgttttatttagttttgctgtctctttagtctccattctaaaacagttctttagtctttttttgacttttatgagtttgacactttgaagattacaggccagttattttgtaaaccttttctcaatattgttttgtctggcatttacttatgattagattcaggttgtgtatcttttagcaggaatatcacagaagtggtgctgttttcttctcactgaagcctattgggcagcacatgattttgatttattctattactactgatgttcattttgatcatttgattaaggtgttaatctgctgggcttctccactataatctttttcctttttacatacagtatttggaaaaccgttaagtgtttctacctaattctcttcaattatccccgcctttcctttagccattcctgaaacaatatgcttttcagaccctgcactatctggtcagattcctcaggctatacctccacagcttagtaagagcaccacagttctacttttacattcttaacttgggaaactgatagaattaaattatgttctttaaaggcaacataaagtagaaagtgattccaatatacatgtgtttgcttaacattacccttggttgcaaaaacaaagtcaatattttttatagtcagctcaacagcaccctcttgtactctgaactcctggtaccacagagccctaagtattttgtaaaaactactaaaacctcatttcccaagttattgctatctgcacatatctgtggtattgcagaaaattatggaatgttattctcttgccccatagtcatgccagctgataccagcggtctattacagtgaaaatctcaatttagcatcttcttatgatccttcatttagaccaacaagttttttcaaaacttcaaagttttcatttagattaaaacgttgtttcaaagtttaaagggttttttccttcagactgcaaaattatcttggtaaatagcagataacagctttgacataaatatgatgatcatttaacagagaaagcttgctttgtgttccttgacaacatgtctgccacactaataaggaacagacttccctaaggtcattatttttttcaccttgaagtaaatttgcatttgtagttccttttaggtgccatgcttatagttttagaagctactactgtacaattaagtagcaagttataattatgcatcagttaacgacagggataccttctgagaagtgcattattaggcggttttgtcattgtatgaacatggtggagtgcatgtatacaaacctagatagtatagcctcctatacacctgagcctactgctcctaggctacaaacctgcaaagcatgttactgtactgaatactgtaggcggttgtaacatcatggaaaatatttgtgatctaagtatagaaaaggtgaggtaaaaatacagtatgaaaggtaaaaactgatacacccgtatagggcaattaccgtgaatggagcttgcaggactggaagttgctctgagtgagtcagtgatgagtggtgagtgaatgtaagggcctaaaacattattgtatactactgtagactttataaacactggatacttagcttacactaaatttattaaactttgtgtctttcttcaatcataaattaaccttcgcttattatacgttttttactttataaactttaattttttaaatctttttgacttttttgtaataatacttagcttaaaacacaaatacattgcacagcggaataaacattttcactctgcatctttattctgtaagcttttttctttttaaaaaaatatatttttttactttttaaactttttgttaaaaactaagacacaaacatacacattagcctaggcccacccagggccaggatcttcaatatcactgtcttccacctccacgtcttgtcctactggaaagtcttcagggacaataacatccatagagctgtcatctcctatgacaacaatactttcttctggaatacctcctgaaggacctgcctgaggctgttttacagttaactttatttatcataagtagaaggagtatactcttaaaaatgataaaaagtatggtatagtatactaaacacataaactagtaacaatcatttattattatgaagcgttacatactgtacatagttggatgtgctgtacttttatatgactagcagtgaagtaggtttctttaccccagcatcaacacaaacatgtaacatgttgcactgcaatattataatggctaagtcaataagcaacaggaatttttcaccatcgtgtatacattccacatgattgaaatgctattatatggcacacgactgtaacaattgaagttaaagtaagaataacctgtctattgtctaattgtttctttataaaatcttgctacagttgtttatcttcctctagcttcaatccaaactttgaatttacgggataaaacgaaaatgcccgctgggcatggtcgctcaagcctgtaatctcagcactttgggaggctgaggtgggcagatcatttgatgtcaggagttcgaaaccagcctggccaatatggcgaaactcgtctctaccaaaaaatacaaaaaaattagctgggcatagtggcgcgtgcctgtagtcctagctaccctggaggctcaggtgggaggatcgcttgggcctgggaggcgaagccgtgatagcacacactgtgctgcagcctgggtgacagagtgagaccttgtctcaaaaaaccggggagggggagtgctgagtaactagtaatctggattatctgacaagagaaaatataaaaactaatctacaaaataaacatttttaccagaactaagcccaaacagaaatatacttttttttgaaaccgaatctccctcagtggcccaggctgaagtgcagtggtgcgatctcggttcactgtaacctccgcctcctgggttcaagcaattctcctgcctcagcctcccgagtagctgggaccacaggcgcccaccatcacacccagctaatttttgtgtttttagtacagatagggttttgccatgttggccgggctggtttcaaactctgacctcaagcgatctgcccgcctcggcctcccaaagtgctcgattgcaggcgtgagccaccacgcctggccaataaactcaaacagaaatatattttatgggtctttctgcaaacagtactgataacataagtgataacgaaaaacacagcctctgttcaataatgccttctatttaataatttaaaaaatacaaacgggggaaaagaaaacacaaaaaatttaccatcctatggcttggtgtggtggctcacgcctgtaataccagcactttgggaggccaagatgggcggatcacaaggtcaggagatcaagaccatcctggctaacacggtgaaaccccgtctctactaaaaattcaaaaaattagctgggcgtggtggcacgcgtctgtaatcccagctactcgggagactgaggcaggagaatcgcttgaacccgggaggtggaggttgtagttagccgagatcgcgccactgcactccagcctgggcggcagagcgagactccatctcaaaaaaaaaaaaaaatttaccatcctatttctcagagataaacatcaaaataattaataatttatatacttttgatcttttcctatccatacactcatatttaacaattatttttaagctgcttttttcagttaactatattgtgaacatctttgaataaatgatgcttttttttttttttttttttgagacagggtctgctctgtcacctaggctggagtgcagtggcttgatcaaggctcactgtaacctctgcctcccaggctcaggtgattctcctgcctcagcctccaaagtagctgggattataggcacctgccaccatgccctgttaatttttgtatttttagtagagacagggtttcaccatgttgcccagtctaatgttaaactcctgagctaaagcaatctgcctgcctcggcttcccaaagtgctgggattacaggtatgagtcacggaacctggctcattaatggatgattctttatcaattctcaataaaagcaaaggcatatatcacattgaattatgcttaaatgatgatatttctgtaagcagcctgataatatggttcaaatgcattctgagagttcagatatgaagtagatgctttcattgactgtaaaaagcaatgttgtttccttttcagataaatactgttaatcaagaaaatacatgccagaatcctttctttttctttaatttaatttctgtaatttaaaattgcttaaggtaggaagacagaattttcaagctccaatggcttttgacagtggcttggccaccttcatttagtcagtcatatcttttaagtgtttgatttcttagcttctaagggctatcactacggggacacattttagggttgggttttgttttgtttttgtttgttttttgcttattttgagtagtgcaaggtcatggtacccacagaacttttctttgtgtctgccattcttaagagactgtattaagagagcaatctcagttttattacaaataattgctgaaggaaatggagtatattgattagatgaaaatgtttaaacaccactatgcatgtgacgtctattttgtcaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagaggtaagcaatttatgtttaattattctgaattcgaaattgtctttgggtcgaaaaataaatccaaatcaggtttttcctgacatgactcaaattagtaagttgcattttaattaattgatagagaaaacttactgactcagttggatccggctcccacccagttctttccttggtgttagaatagtctgtttaatttgattgttggaggaattgacattgccatataaaaggtgataggaattctttaattccagtttggcctctgttactgattacctgtatagtctgcagaagagtgtttgatttccctttactgtttaagacttaaatgataatgctgttgcctcatgaagaatgttaaaaaccagctgaaatattgagctgtataagcggtgatagagtgtgtttattaaacagatatttactgagaacctaccatgtgccaggcccaattctaggcacttgggtatatgaggtacttggtatatatcagtgaacaaaacaaaaattctagcccttatgggagtttgtgttctagtgtatattagtatagttgtagactggccaattgtatctaacttcataacatcaaaaacacatctttagggaactgatggcttctgggaagctagctacttgattccatagcagtgatgtcttatcctttagggggtaataattaaacttatataatttaagcatgtgaacacttaatcctgaagttcaatctcagcatgctaacaggtaaagagatgtagaactggaagacaggggattacatcattaagattagccttcttggccaggcccggtggttcacgcctgtaatcccagcactttgggaggccagggcgggaggatcacttcaacccaggggtccgagaccagcctgggcaacatagtgagaccttgtctctacaaaaactttaaagattagccaggtgaggtggtgcatgcctgcagtcccagctgctcaggaggctgaggtagggtggaaggattgcttgagccccagagtgagaccttaaaggcaatttttaattctatttatttatttcttttgagaaagagtcccactctctcacaggctggagtgcagtggcaaaatcatagctcactgcagcctccagctcctgctcaagcgatcctcccaccccacctcagccttccaagcagctgggactacaagcgtgtgccacttcgcctggctaatttttaaatttttgtagagacagggtctcactatgttgcccaggctggtgacagacccctgggctcaagtgatcctcccattttggcttcccaaagtgctgggattataggcgtgagtgactgtgctcagctagattagccttcttgagtctcttgattaacctagttgtggccaacataattgaatatcaaaataactccagatcctggtatgttaaataatagcaatagcagtaatagcaaacacatgtagtgcttagatgtgctaaacactgttctaagtacttaaaattctgtttcatattgaaatattagctgccacttcttccttttccatccacccccatctatgtacctgttattcacattttaacaaaatgggtgaatgtaatgctattatgatgccatcaaagaactgaatttgcgtggtcatgtaacttttcatgtgtctgctgttcctaagagactgtcttaagagagcaatctcaattttgctacaagtgatatgtgaattcattcttataaaacatcaagtgattacctatagggttatggtccttttcttaattctacaagtaatacatgttcattatgaacaaatgtttaaatatagaaagtcacaaataattttaaaaattacctatgatctcaccacccagagattaccactgttaacatcttgtttttgccactttattttcaacaatatcagatttacaatgaagaaattttggatcttctatgcccatctcgtgagaaagctcaaataaatatacgagaggatcctaaggaaggcataaaggtgtgtttgtctctcatttgatgttattaaaaaaatttggcaattataatactaaagttcacatcccttttatctgccactgtggttttaaatgactactatcatctcagtcaggttttctgtggtcctaagtccctttgttaatctaaaatttctaggtgggagctcttgtggggaagcaaggaaagacgcatgttcagttttatcaccttcctgttacctagaggaatgccaatatcaattaaatattatttacagagttctaaggctgagcagtccagtatgttagccactagccacaagtggctatttaaatttaaatgaattaaaattgaataaaattttaaaaattcatttcctcaggcacactagccacgtatgaagtgctcgatagctacatatggctagtggtaaccatgtttgagagcacagatagatacagaacatatccatgtattttcttctgggtcattgttagccagctactaatgcatggatatgattgaacatatctatatccaatagaaaattctgttggacagcactgtaatagacattttgctgggctttgggatgatatttttaaaattgaaaagttaaactatatataatttttaaaacatgtaagtatcataggaagaagagatagcttatttgagaatcttctgtcagatggtatagatgcaagatgaggagctagaactgaacagaaaatgtgaggcaaaattgagagtttcctatgtgggagtgagccaaatccagaagccagtgttgaaaacaggcagagcttgagtattcaggagtgggaaaatcagaggctggaggtagatgaggctaggtagtactctggaaaacttggaataatatcttactcctgttctccttcccttcttctcttgcacaaagaaaaacagagaaagttgaagatttggggtaccagtgagggacaggtgcctgtgctcctgatttttttttctgggtcattaagttgttagccagctactaatgcaaagtttaaaggatcagccctgataagcttggaatatgcaaagatgatttggatagtgaggataagaaacctggacaaaatacatgctattgtactgagccagcacttgaccctgtttcaagatcttttatataccccatgttaaggcaggaattaagtcctaagagttgtttgaggtgagatttgcaatacagagaagtatgagttcctgacacaaattggtaaggaagagtttgtaaacactcttcagatgggatggataggctttaagtaagtagagaaaataaggatattcttatggtaaggaatagctttagcaggaaagcagaaaatatacacctgagggtaataagactacacaagtctgtctggattagaggatttgggctgggaagtaacaggagatatgttaggaccagattatgaagccgggctaaagagcttagtttctatccctgtgaaccatataaactatgtaaaacttctgagtgagggattactgtggctacttttaccaagtttttatcttatgtgtgtatctctccaactctgttacaagtgatatgtgaattcattcttataaggaattcaccctaacctggaggtcaggggagtactttgaaatctctttgtatcttcgttatctagcacagggcttagtaggttggtgacattttaggaaaaccaaacagaaatggattgaaaaggagaaagactgggatgagaaagaccagttggggaaactgttgcttattttttaggtgtgaagtaatatgggcctgaactaggcaagtagatgtgtaaaggaaaaggaagtgatggattcaaaaggagaatgactagtagttggtgatagatattatatggaggagtgggagaagttgaaggtgatgtgagtttttgagaatatgagacaagattaatagaaatggagaagtattatagtagagagaattagtgtttgtgggaggaagatgaatttggtttataattgactgatttcaaagtgtaagtggtaaggtagatcattagaaataaaagactagaaattagggccacagaagtaagtttgggagctatgaagtaataaaattatagcatattggagctagaaaagacttcataagcatctagtccaatcacctcagaggctccaagagattcaacttgtataagttctccaaggtaaatacagtactaagcctggggtcctgttttcctggcttcctaatccagtggaaactgtaccatgctatttcctctagtgaaaatgaggttaaaaatgaatcagaggtacagagaggagcatggggtcagataggggtgaaagtaacaaagagaaatgccatcgctgtttgtgttgtacttgctctccttgggaccagaattaacttcacttggggtttcttggaaggcacgtagccattgctaccctaaaatcttgagatcttttctagctccagtattagctggcacgcttgtttctgaagttcctaaggaagattggagaccttagtttccagctatcttcacagagttgccagttaaagcagttcttatcaccatgactgttctatttgaggttctactagactatcaaggcatttttttaaaccaccaatccctatatttctgaccaagcatttgaagtataaatcataagggaattttctctttcttgcaattagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagtaagttacaatttaaagagtcaagatttttagtattagttctattaaggttaaacattagactgcttcttcaattgatttgacaaatcatcagacatcagtattgtgagcacgagtgactaatggagccattttgactgacttgaaagaaaatgagagctgacaggtcagctttgatattcagttactctcaagcttgtgtaccattctcactgtgtcttcctttcattatcacaggaatagcagctttcgctccaagctgcatcttgtagacctcgctggatcagaaagacagaagaaaaccaaggctgaaggggatcgtctaaaagagggtaagagagtaattaaggtcacagttgtagattaaaaacttctagtactcttgttggtattgttggtgttttcgactgggatttgagatcacattctaacagtagctacgattcagatttgaggctgagttcagaaatagcgaaaaattgtttctttcccttgctctcattctctaattcaggtatgagatttggatctggcctttggtttgatttcatctggtccaggcaagttttagttttagttttgttttgttttgttttaccccaactatttataattaaaatcagtatcctgattctgtcattttaagtattcaccatcccttccagatgttgtcacatataaacctcagcccaatttccatgccttcattcaagttgttgaatttgaaaagtgatgaaattcctaaggctagaagaaccctgtgatgtaggctattagaaaccttcttctaacattatagtgacctggtaatctgcatgccttggtaatgatcttgaagtgattattaatctctctaacaaaaattaacatccagctctatatctcaattttgttcttaaggatatcataaaatagttcatcagatgccttgctaaatccagatacaccatatctactgtatttctcatagctaccagcttagtaacaatacaaaaaagaaataagggattttagcctaaagtgctttttcttggtgaattcaaggttggcttctagtgcttattcttctgttttctaggttcttgcatgctgtccctctaataatccactctagacttatatcaaacccactgtttggtaatttatggaattaacttttatccctgttttgaaaattgaaattgcatctgcccagtcttctagaatgtctttctctgtgattcgtcaaagatcattgacatagcttcagcagtctcgtttgaaattactctatgttcccttagctataattcatctggtccaagatatttgaactcttattaaagcagttgggtttacacttactacctctttactcatattgggcttcatttctctcttgggaactgagaaggcagaaggaaaaatattaattgaggaattttatttctgtcatttatcattattatactgttggcactgagtgcagacctgtttcttcctcattcagctttttgttctgagtgtcattcaaagtaccctttttgttctatgtttgcacttgagatttagctttcctaagactatttttaaaggctgtaatgctttctttatcttcttttaggtgttcagttccaagttgttttatttaacagctttattgagatataatttacgtactataacattacctatttaaactgtacatatcagtggattttagtatattcacagagttgtacaatcatcatcataatctaattttagaacattttatcatcccaaggagaagccccatattcattagcagtcactccccattcccacccctttccctggccctaggcaaccacttaacttacatttctttttttttatttttttattttattttattattattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccgcagagtgtgatgttccccttcctgtgtccatgtgttctcattgtgcaattcccacctatgagtgagaacatgtggtgtttggttttttgtccttgcgatagtttactgagaatgatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgcaataaacatatgtgtgcatgtgtctttatagcagcatgatttatagtcctttgggtatatacccagtaatgggatggctgggtcaaatggtatttctagttttcgatccctgaggaatcgccacactgacttccacaatggttgaactagtttacatttcatataaatgtaatcatacaatatattgtcttttgtgactggcttagcctaagattttcaaggttcatccatgttgcatcatatatcagtacttcattcctttttttttttttttttttttttgagagagagagagtctcactctgttgcccaggctggagtgcagtggcatgatcttggctcactgcaacctccaccttccaggttcaggcagttctactgcctcagcctcccatagctggggttacaagcatgtgccaccatgcctggctaatttttgtattttttagtagagatggggtttcattcaccatgttggccaggctggtcttgaactcctgacctcaagtgatccacccaccttggcctcccaaagtgctgggattacaggtgtgagccaccatacccggcctcatttctttctattgctgaacaatattccattgtatggatatgccacattttggttgttcattcatcagtcatatccaattttctctgttatgaacttctgtgtgtaaattttcacgtggacaaaggttttcatttatcttgggtatatacctaggaatggaattgctaggtcatatggtaactctgtttaactttttttttaaaagaataaaagatataattatataattaacataccataacactcacccttttaaagtatacatttcactgatttttagtatgttcacaaggagttgtataaccatcaccgcaataaattttagaatattttcatcacctcaaaaagaaatccatacccattagcattcactccttatttcccctcaatatatgttcctcacctctcatcctaggcaataaccaatcctctgtctctgcagatttgcctattctgggcatttcatataaatggaattatacaatatgtggtcttttgtgactggcttctttcacatagcataatgtcaaagttcatctatattgtagcatgtatcagtactgaattctgttttattgccaaacaatcttccattgtatggaaataccatgtttttatttatccattcatcccttgatggacatttgggttgttttcattttgggttattatgaataatgctgctatgaacatttgtgtatgtttttctgtagacaagttttcatttctcttgagtgtatacctatgagtggaattgctggatcatatggtcactccatgtttaaccttttgaagaactaccatcacactgtttttcaaagcaacgacatcattttttgttctcaccagcaatatataagggttccagtatctccacattttcacttgttacttatttatttttcaaactcctgggtgccatcagatttgcttgttattatgcctttttaattatagctatcctagtgggtacgaagtggtatctcattgtggtttttatttatatttcactgatggctaatgatgttgaacatcatttcatgttatataacttttggaagaatgtcctttcatatcacatttaggctttgacccattttgagttaatttttgcatatgatgtgaagagtggtccagtttcttttgcatctgtatatgagttatcccagcatcgtttgttgaaaagactatcctttcccccattgaattgtcttggcatacttgtcaagaagcaactggtctctattcctttgatctatatgccttacgccttatgtcttcattactgtagctttgtggtaagttttgaaattgggaagtgtgagtcctccaacttcgttcttgttcaagattgtattggctattctgggcccctttcatttccatatgaacattaggttcaacttgtcaatttctgcaaaaaagccagctgggattttatagagatttcgctgaatctgtagacccacttgggaagtattgccatcttaacaatattaagtctttcaatgtatgaacatcagatgtctttctttttctttttcaaattttttcaaattttttatttttatctttattttattttattttttgagacaatctcactctgttgcccaggctggagtgcagtggtgtgatctcggctcactgcaacctctgcttcccaggttcaagctattctcctgccttagcctcccaagtaagtagctgagactacagacacatgccagcacacctggctgatttttgtatttttagtagagacgggacttcaccatgttggccaggctggtctcaaactcctaacctcaagtgatccacccgccttggccttccaaagtgctgggattacaggcatgagccaccgtgcccggcctcttttttttttttttagagacaagatcttgctctgtttcccaggttggaaagcaatggctgcagcctaaacctcccaggctcaagcaatcttcctacctcagcctcccaagtagctgggactataggcatgtaccaccactcttggttgatttttaatttttttttgtagagacgggtctcactttcttgcccaggctggtcttgaatgcctggcctcaagtgatcttcctgcctttacctcccaaagtgctggtttataggcatgagcgactgtgcttggagtatctttctttttatttaattcttttttaatattttttgataatttttttttaattttcagagtataagttttacacttcttttgttaaatttattcctaagtattttatcctttccaatgctattgtaaatgcaattgttttcttaatttcattttcaatttgtttattgagttttgtagatcttgtatctgcaaacttgcagaacttattagttctaatagctttttaaatagatgctttaggatttctgtgtacaagatcatgtcacctgtgaatagagatacttttacttctttctttctagtctggatgcctttacttctttttcttgcctgcttgtcctgactagaagcgccagtataatggtgaataaaagtggtgagaatgaatgttgttattttgttcctgatcttaagggaaaagcattcagtctttgttcttcataggtgccctaccaggttgaggaagttcccttgtacacctagtttgttaagtgtttttatcatgaatgggtatttgtcaaatgcttttttgtcatctattgatgtgatcacatgatcacattatttttgttctttagtctattgatatggtatactgcattaattgatttttgaatgttaaaccaaccttgtattcctaggataaatctcacttgtttttgtttgtttagtgactttcctggactgattctgtaaactggattccctgtagtttgccatcacagaagtgtcttctctgttaatttagtggttacttgatgactggtctcagttacttaaatgccttgaacctatacatcttccaccatttgccaagagttttgtgtctgtgtttgggcatatgccttcaacactcaggcacttttacaactctgccttagccttcactgcttaaacagagtctcaaagtcagccagagatgcaaaatttatggctttttaggtctttcctgagcatgtagacagccctatacattcagacaactttctagaccttcagaaatatatctgaactttttaatccccactccctcccgtggatacctcatttcccagaccttttaagctcttagctaggcttttgtttaaccatgattattaagtttggtgtttatctttaccagatgtttttctgtgcatatgtgtatgtgtgcatatagtaatatagtttttatatacctttaaatattttggcattgcctaatttatttatttccttttaactatacaagtaatacatgaatagattctcatataaaaatacaaacaatacagatgaagataaaatctaccttgatttaccacccagtcctaatccagaggtgaacactttcatctgactggtgggtatcattcaagattttttcacgtacacatatattttttattggtgttgctgtgtttttaaagataaatgtcatcatgctacacatattgtttttcaacttgcttttatctcttcgtgatacaacttagattttttgttttgttttgttttaagagatggagtcttgctctgtcatccaggctggagtacagtggcacgatctcggctcactgcaacctccgcctcctgggttcaagtaattctcctgcctcagcctcctaagtaggtgggactacaggcacatgctgccatgcatgactaattttttgtattttagtagagatggggtttcaccttgttgcccaggctggtctcgaactcctgagctcaagcaatctgcctgcctcggcctcccaaagtgctaggattacaggcgtgagccaccacgccaggcctgagatcttttttgtatcccgtgtatataagtctacttcatttaaaaaactgttacataggattccacggtatacagtctaccttgtttattcctattttggttgacatttcagttttccaatttctggctattggaaattgatgcctcactagatagccttgtacatgataaacatgtgagagtattctctgttatgtacctgaaagaggaattgctagattgaagggtatacacgtttgagtaaatactattaaatattgcacaccaaaatgtctgcctctttatccactctacctacaaaatatgatgatgtttctctatactactgacaatattggatattattgacctttttagtcttgcctctcttgaatattgcatgttattggctatttctctttccatttctatgaattgcctgttcataccatttgcttattttttcttctttcatgttgtatttttcttattgatttataggagttgtttatatattctggatattaagccttagttacatatattgcatatgttttcctcagtctcattttttaactttattgatctttttcatttgtgccttgtgtgtgtttttcttcttacatattttttctatttttgaatatgtaaaattggctacttaaggagcaatagctttttttctttttcagccttattgaggtataatagacaaaaaaaattgtaaatgtttaaagtagacagtgcgatactttgatatatgcataaattgtgaaatgattaccacagtcaagctaattagcatatcaatcacctcatgtagttatatttttcaatatgttatttcttgaagtaaaatttatatacaattggcctggcacagtgactcatgcctgtaatcccaacacttggggaggtcgagaagggcagatcacttgaggccaggagtttgagaccagtctggccaacatggcaaaccctgtgtctactaacattccaaaaattagccaagcgtggtggcgcacgcctgtagtcccagctactctggtggctgaggcacgagatttgcttgaacctgcaaggtggaggttgcagtgagccaagatcacgccactgcactccaggctgggtgacagagtgagactctttctcaaaagcaaacaaaaaaaatttatatacagtaaaatgcgcataccttaaatgcttagtttgttgagttttgctagttatatacattcatatatctaccaccaaaaatatcatataaaacaattccatctttccagaaacttcccttgtgcccctttccagtcaatccatccttcccccattccacttccagcaaccactttctgacttctgtcaccatagattaattttgcatgttcttagacttcattacagtgggatctcaaaatggttgtgtgtgtgtgtgtgtgtgtgtgtgtgtgtgtgtgtgcctggattcttttgctcaacatagtgttttttgagatttgttcatgttcttgctttgattagtgattttcctttgtattgctgagtagtattcaattctatgattataccactatttgtttttctattctcgtattgttgagaatttaggttatctcaaatttttagctattatgaataaagctaccctgaacatttgtatacaggtctttttgtgaacatatgtttccatttcacttggataaatacctaggaatagaagagggcaagcgtatgtttaactttatgagaaagtgcctaacagttctctaacatggtttgtatcattttacaccccagcagtgtatgagagttccagttttttacgtttttttgtatgctctggtacagttgatataacatggaaattatctctgaaggtttcttgaagatttgattttctatatcttgagccaattctggtcatttatattttcttagaaaattgttcattttggccagtcacagaggctcacacctataatctcagcattttgggaggcctaggtaggaggatcgcttgagcccgggagttggagaccagcctgagcaatatagtaagatcactgtctctacaaaaaataaaaaattagccaggcatggtggcacatgcctgtagtcctggctactcgggggactgaggtggaggatcgattgagccctgaagaccaaggctgtagtgagccaagatcgcaccacagcactccagcctgggtgacagagtgagaccctgtcctaaaaaaaaaaaagaagaagaagaagaaaaagaaagaaaattattcattttttctgattgccgaatttattaatataatattgcaaatagatttactttatagttttaatctcctctttatctgtagttatgtctcactttcatttcaattgtttatatatcttctgttttttctatcacatttgacagattaactctacctttttccaatttttactattactctattactgagttcttcctaagttgttttattttgttttatgttctttttattgcttcttgagttgaaagctgagtttacttcttttcttctcctttttaaaaaagcttttcaagcatatacagaagaggtcaggatggtataatgaatgcctcccccaatatacctgtcatgaagtttcagcaatgactaatttatgaccagtcttgttttgtctatataatacccactttctccctctgatattatttgaaacaaatcacggacatattgttttatttttttcagtttgtatctgtagaaattaagaactcttaaaatataatcacctaggtcaggttcagtgactcatgcctgtaatttcagcactttgggaggtcaaagcaggaagattgcttgagaccaggaatttgacagcagcctgagcaacatagcgagaccccaccatctctacaaaaataaaaaataaaatagccaggtgtggtggcatatacctgtagtcctagctgaggcaggaggatggctggagcccaggagtttgagactgtggtgagctgtgattgagccactgcactccagcctaggccatagagtgggaccgtctctaaaaaaaaaaaaagaaaaaaaaatatatatatacacctaaaaattaaattaacaataatactaatgccttaaaattacatatctagtcagtgttcaaatttttaattgtcttatagattttatttatttggatcaggatacaaacaaggtccacacattgttattgctcaataggccttttaaatgtcttttttttttttttttttttttaagacggagtgtcactctgttgcccaggctggagtgcagtggcatgatcttggctaactgcagcctctgcctcccagattcaagtgattttcctgcctcagcctcccaagtagctgggattacaggcacacgccaccacgtccagctaatttttgcatttttagtagagatggggtttcaccatgttggccaggctgatcttgaactcctgatctcaggtgatttgaccacctcaacctcccaaagtgctgggattacaggcatgagccactgcacccagccaaggcctaaatgtcctttaatctctaggtacctcctccatctttctttacccctcaagtccctggaatttgtttattgaagaaatcaagttgtcttgtagaatttcccatagtgtgaattttgccaattgcatgcctatatagtttcacatgtttcacttttattctctatttcctataaattggtaattcgatctagaggcttaatcacattcaagatcaatttttttcttttatttgcacatacataactatgtctcatttattttcagttgttcttatctaaaaagatatatttaaagctatacatctcctctaactaccacttcaatctaatcttataattttgagaaatagtactcttattgttcatgtctaaataggatatttactctttcattttctctcaaacctaaaagttatttagaaggtgcttctgtctttccttttattgtcaatttctaatgtattgcattatgttcaacaaatgtatgtgatttgtgttttttgaaatttggcctatacttatttggtctttattaatattctgtttatatttttaaaaagtgtattttctcttgggtgtatagttctatatatacctattagatgagcttgttacttgtattattcagatcctcatgttctttttttttacttaatatgttattttctcacagtatgaccaagaatttgtccatttctccttgtatttcttagtttatacattttatactttggagctatgttgccaactgcataaaatgtcatgacatacgtcttcttagaggattatatctattttgtctaattagtatttcttcacctactttctctttgttagcccttacctggtatgttttccatccctatcttacagaaactttgtagcttgacttcattaattaatttatccattcatttatacccaatctgatggtctctctttttaatttttttttcttttattaaactgcttagggatgatgttctcttttaacaggtagttttaccctctgtattcgtgtgtgtgtttggacttatttctgtcatatcactgactattagtctatggtcctactcctgctcctgtaccacaaccagataccttgaccattgtcccagggcttccttctgttttccgaatccactaccttcaagtctgtagtactcctgcagttgctgccaactttttatatcagttctctcctgcatattttttcttatgttggtctgattcatctgctttcagtctctcaaggattttgtggtttctgatccaccagtgatggattcacaggaagttggtggctttcccacttggcagcctattcaaagacttttaggggctctaaaggaattttactcaattgcattagagggttttacatacacattctgggttgcccatcttagcttcagagcttcaatttcctcatttgtaaaataggatttgaatatattctccaatagagttgtgggaattaagtgaactcatattcgtaaaacatttaatgcaattcttagtaaatagtagtctcttcataattaccaattccatcatctgtgtttttacttgctctgagtgtggctaatgaggaatataggggctctactgatatttatatacaatctcagctgaactaagatccctatgagcttgctaaggtgcttgtcaacatttgaggtagatttcgagggtggaagaaacttttagggatatggcttatacctgtggaattaacttttctttggctaccaaactgccattgtcaaaggcaagtcctccactgttagagggaatcattttctacttatcaagaactaagaaagttgctaaaccctctggaatattttcagaaggtggatatggcccggcagaatattgttacatgttgcattactgtggattgggggaaaggagatgtacccaagtgtcagatttgactcgtgaggcaaagaagtttatgacagaatcatagttgagtcctacatcaagtggcagatgccaagagttgaagggaagctagtgagaaaacaggagataggtatataggaagcagacagcagatggaaagattttggacatgtcagatttggagtacatattagaaaaatccaggaagaaatcagaaagtcaggacaagagcttagaagcaacatctgggctagagataaatatttggaatccatgggtaggagagttgtgcagagaaagactggacaatcaaagagccactagtaaatattaaataatattagtaaatactaaatatgagcgaggggcactcatatttaagggccaagggtaaatgagtcaataagagaagctgaagagacactggaggatcatagtatctagataaccaagggtttttataaacaaaaaggactgtcacctgtgtcatatgcttcagtgtgattactgagaagaggtaaatagatttgtccgttgaggttttgggtgatctttgtcagagcagtgtcggtcgagtggtaaggaattaggacaggttgtatcaaactaaggggtgaatttagccaccattctaaatgtggtgtttatcctttccattaatttctttattcttatatcctttaatgatatgtagtgacattttgcatgtttctaaacttaatgtaaggggtttcatggtatatgtgtcttctgaaactgattttttccctcaacattatgttcttgagatcaattcatcttgataatatagctctgttctaacaggttttgttaactagaggcttgagttttcttggtatcaaattgtatcagtaagaagaaagttacctctgccaatatttattcctttatttaattctcttatgtttcttagcaatgagaaaaatgtcagcagatataccctggactagtaaagttgctttcctcaggggaatctagtttctgatttaaatcagaatggttttaatgttttattatttggaatgataattgctattggtgttggtaaatggtatttaattctcttagttctaaagtcttttttaagtgcaaattgtctgtttcattcagcaactctattcattaaagtcctgttctaagtgttctgcatgttctttttggcttctgggtccctttaggtgtattgttattttccttggtctgctctctgggactgaagtctaatgctggagtatctgaagtcatagcagcccagtgagtgggaaaagcacagtggtttctgcccatgagctagcaggcgtattgccagtcagcttgtcaaacccatgaggaggcatcaggaggaggcctctctgtactcttgtttccttgtgctttcttagtctcaaggtagagaggacccaacccatctcattgttttcttagcattttcagatggggaaacctggcacactcacataagcagtattgactttccccctaggagttcagagtggtatgggcgaagcctttgccacagaccatgtttccatccttgcactttggctctgctacaccacactcttagcccagggcttttctctgttccagagatgaaaaattctacatcaccccttactctcaggtctcagacccatcctgcaacctacttttttggctggccccagcacctacttggcttaagaacagtcaatgaatcaggtttgggaatagaggcgatttggaatattttcaacttactatcttcccaaaattcatgtaccttttaaaaatagatgctaccaaactcccatgaaggaatgatgagattattcattttcctaaattctctactaagtattattaccaatttgataagtgaaaaatggcatgtcactttcatttctgtagttattagtgaagttgaacatacttttatatttataggccatttatattcctgattaaattacctattcaaagtatttctctttagtcagtgtgagtgctgtacattttctgttaagtttatccctactttttgttgtgattttgaatataaaacatatttaggccactgccagatagattataaatagattacagatggataataggtagattattcaattgaagtataatatacatattacacataaatatatattacatatacatattatgcatatatgtatattgcatatacatatatgtgtattacatacatattatgtaatataatgatatcaagtcatcattatacagttcaacgaatgttcacaatatgaaatacatacatgtaaatagcacccaggtgaagaaacaatattctaagcatcccagaagtgtcacttgtgctctcttctagtcactgtcttccccaaagagtaaccactgtccagacttttagtcctagattagttttgtagtatggactccttcatgtctgacttctttcactcaatgtaagatctccagagaaaatacaagatgcctagataaatttgaatttcagataaatgacatcattttgtatggaatatacctatattagaaatgattcatcatctatctgaaattcagatttaactggatgttctatattttttttcttttaccaaatctgataaccctaactcaacattatgcttgtgaggttcatccatagtattgcatgtagttgtagtttgtttatttttcattacaatatagtattccactgatgaatgtaccacaatttatcctctttactgttggatgggcatttgggtaatttccagtttggagttgctttgaataatgctatgaatattcttgtacaggtattttggtgaatatacgtacctaaattcctttaatcctgaatcctcctgtaactactgtcctatctccttccctttagactcaagcttctcaaaaaagcttacactgcttagcaatacatgtgattaactcttagtttcacttctttggtgagacatagcatacatacagaacattgcataagttatgtcatgtatctagtttaataaatgattataaagtaagcatctatataactaccactcaggttgaaaacaaaacacttccagcacccatgcatacccctccgagatcatgatccccttccttctctctccaggtatccattcttctgacttttgtgatgtcaattcccttgcctttttttttttttttttttgagacagggtctcgctctgttgcccaggctgagtgcagtggcacaatcacagctcactacagcctcaacctcctggactcaagcaatcctccctccttagcctcctgagtagctgggaccacaggcacatgccacaattcccagctaatttttaattttttctagagttgggatctccctatgttgcccaggttggtctttaattcctgggctcaagcagtcctcctgccttagcctcccaaagtgttggaattacaggcgtaagccaccacacctggccccccttgcttgcttgcttttcttttctttctttctttcttttttttttttttgagatggagtctcactccattgcccaggctggagtgcagtggcgtgatgttgggtcactgcaacctctgcctcctgggttcaagtgattctcctgcctcagcctcccaagtagctgggtttacaggcatgtgccaccacacccagctaatttttctatttttagtagcgatggggtttcaccatgttgaccaggctggtcttgaactcctgacctcaggtgatctgcctgcctcggcctcccaaagtgcagggattaccggcatacaccaccatgcccggcctccccttgctttcttgatagcaatgccacctgtgtatatatctctaaatagcataatatagttttgtctacttttaagctttatgtaagtggaattatactgtttataatctgttgtgccttcattcttccatttaaaatgatatttgagagattcatctactacattacatacagctgtagttcatttcttttcatttttgtatagtaatctatcatttgtctgtaccactattctttctacttttgatggatattccatttttttccagtttttggctattgtcaacaacgcccatatgaaccttcttgtttgtgtatcccaatgcatatgtataagaattttctaggatatgtacctagaagtagtatcactgggttatagagtacatatataccaaactatctttcaaagtttgtttcaatgtatgagagtcctaattgctctatatccactgttttgtgagaattttaaatttttgccaatatagtagatgtggagtgatactttattatggttttaagtttcatttcctcaattactaatggggttgatcaccttttcatatgtttatcgaccatgtgtattttcagttaaatgcctgttcacgtcttgctcatttttctattaaatgtctttttcctactgattaaaagtaattcttaatatactatagattctagttattggtcagttatatttattgcaaatctccccaccctgtgtgttttgcacatatcttctccctcctctctggcttgtgtttttactttctttttaattttgtgtcttaagaaatcctttaggccgggtgtggtggctcgcgcctgtaatcccagcactttgggagggcgaagcaggcggatcacaaggtcaggagatggagaccctcctggccaacacggtgaaaccccgtctctactaaaaatacaaaaattagtctggcgtggtggcgggcgcctgtagtcccagctactcgggaggctgaggcaggagaatcacttgaacccgggaggcagaggttgcattgagccgggattgcaccactgcattccagcctgggcaacagggcgggactccgtctcaaaaaaaagaaagaaagaaagaaatcctttagtacctcaagatcttaacgatattttttctatattatctaataaaggctttacagttttgcctttcacacttaagcctttaatccacctagaactgttttttttatacatgatatgatgcagggtccagttttgtttttccatataaatacccatttgtcctagtactgcttattaaaaagtccgttctttccctactgataagcagtgccatttctttcatatattaagtgcccaaatatcccttagtctgtttctgagtattctattaaatcaaaattaaatctgagtgtttttccctgtagaagtcttatacatcttttgtactattcttacgtaacttgtattttgacagtattgcaagtgatatttttaaaactttttattgaagtataatgtggaaatagaaaagtagacctaccataaatgtatagcttgctgcattttcactaactgaacaaacccatgtaaccaacataaatagaatctttaaaaattatattttctaactttgttttttgtgtgtggaaaataaaatgtgttctttaatattgattttgtatcctgcaacctcattcactctctcagcagtctgtctttacccaccttgccaaaaccactatgtaagagatatccagggatatcttaattaccagaactaattttttttcagtgcccatcttacccaacctctctgtggcattaacacttgaaaatactctttttgaaactcttaatttggcttgtaaagcctcactgtcctagttcttttcctagctcaaactgttacttttcaatcacttttgctttttcttcttgctgatccattaatctaattgcacccagcatgatctccccaattaggaatgagtacccattacctgctgttagttcttccttagcaccatggtagagatgcacccacttccagtctgttcctgccacctctacaaagtccatgccctcacctgcacatctgaactgtagccttctaactttttgactcctagaaggcattctattctaaataccatagctaggttaatcttaaaataccctttgatcaaagggatacatgtaccgctatgtttattgcagcattattcacaatagcaaaaatttggaatcaacctaagtgttcaacagatgaatggataaagaaaatgtggcatatatacacagtggaatactattgggccataaaaaagaatgaaatcctgtcatttgcagcaacatagatggatatggaggccattatgttaagtgaaataagccaggcacaaaaagacaaatattgcatattctcattcatatgtgggagctaaaaacaagggtataatggacatagagagtagaatgatagttaccagaggccaagaagggtgtgggagtggaggccgaggggaagaagagagaggttgattaatgggtataaacatacagttagatggaataagttctaatgtttgatagcagagtagggtgatgagtgaacagcattgtactatacatttcaaaataactagaagggaggaattgaaatgttcccaacacatagaaattataagtgctcaaggtgatggatgccctaaataccctgacttgatcattacaatttctatgcatgtaacaaaatatcacctatatccataaatatgtacaaatattgtgtatcaataaaaatacataaataaatgaattacatatgtagctttaaaaataccaccttttacatggcatctcacgtaaatagaactttgaagtagctgcttacaagatgaagtctaaaaaacatagccaaatcttccagaccctttataccctggtcccaagcctacctcctcgaccatctttcacagcttccctacccacactccatgccagctgtcaggtccccacaacatgcccagctaattctggtctttgcacactttcatcacagccatctcctcttctcccagaatgtagtgtgtgccccccaacacacaatcaaaccatctacaacatagccacgttttaagactcaacttaagtgttggggttttcgacattgccttttttaatcatgttatcttctaatgtatttttttctcctctgagatttctctagtaccacaggactacattgtcattttctggtgcctctgtatttctagcttcatctcccaccattttcccacaaactacaaggttccagccatagcagtctactcattgtttttccaaacagttctgttgtttcagatctctgtgccattactcctgtgtgttttctgctggattttctccccactgcctcagaaacatggttctgtcaagtactcctgctcctcctgttttaacttctccctctcaactgactttctgccctcagcatagaagcatactaatatttccccaacttaaaataaacaaaatatttcatcctcctcttactactgctctcctcccttttcctttcattctacatttttgtcacccctccatcctcctcccattgaaactatcccttttgaagtcaactcatgacctgaacaactgaatccattaggctcttttcagtcctccactgacttggtaattctgcaggtctgacatcctgccccttcttctggacaatctcattcctcttgactctgtgatgctaccctctcctgattttcctctcacttttctgaagactctttcacaggcttctcctcttccactcacccctatctgaaacataacccaggctttgtcctgggatattttctttctcttcccactgttcatgcccatcaccctgtcaccctccccccccaaagtggtttcacccacttagatgcttataattcctacctgtatgctgccaatcctaaacctctatctcgagcccctatctcataagtcatatttaagtatgtaaatatagttgactgtggggagtcttatggatgtcccacatgtatctcccattccacatgtccaaaactgagcccctcattcctccctgttgctgttttttttaatttattttatttatttatttatttttgagacagagtctcactctgtcgcccaggctgaagtgcagtggcgcaatctcggctcattgcaagctctgcctcccgggttcacaccattctcctgcctcagcctcctgagtacctgggactacaggcgcccaccaccacgcccggctaattttttgtatttttagtagagatggggtttcaccgtgttagccaggatgatctcgatctcctgacctcgtgatccacccacctcggcctcccaaagtgctgggattacaggcgtgagccaccgtgactggctccctgttgctttaaatgggtccctccatcaccggcagtgaataatatcaatatccacccagtcacccaagacagaaaccagggcattgttctatgctcttttttttttttttttaatctggctcctttccccaatctcattagtcactgagacctgtcagtcctaacttttcatcttttacttcactctcttttctctaaccctactaccactatcttatgtcaggccctcatcatttttttgattatagcaagaactggtctccctgtcttcagttaggtaccctttcaagccattaaccaatcagcagccagagtattcttcctaaactgtttctcgctgctaagagctcttccagagctcctcagtttgcaccatgctgcctccttaaggcctttttgctctagccatccctccctggctagcttttcctctccccactctttccttgcaatctgcttagccatactgagtgtgcctcgtactctctcatctatgtgtctttctgcattctgttctctctgcgaaattgccttccctctatcttcatgtggctcattcaaatttgcgctcagtcccaacttcatccccttaaagaaactttgtttgaccatctcacttcccccaaagcggattaggtacccctcatctagtgcttacctgtcttccacactaacactgccccagccgtgtattacagtcatttccttaactacctgactcccccagtagacagcaagccaatcaaaggcaagaactgggtcatattcctctttgaatccctaggccccagcatagcacctgacatgccataggtcctcactgaatgcctgagttctttctcccttttggtctgcctggcaactcctactaatatttcaattcacaattcatatgttacccacctatgaaacctctgctcttggtcaagatctttccataaattcatgctcacatagtgggttttctctaacatttattgataaaaattttcaaagttacttcaagttgaaagattttacaatacccctatacctatagtaaaattaacattttactatatttgctttatcacaaatctgtccatctatccatttgtcagtctatatccattttaaaaacacatttttaagtaaattgcacaaattaatatacttcctcctaactacttcagcttacatatcattaactggcatttaatatttatttatttatttatttatttatttatttatttatttgagaccgagtcttgctttgtcgcccaggctggagtgcagtggcgcaatcttgactcactgcaacctccacctaccgggttcaggcgattctcctgcctcccaagtagctgggacttcagatgtgcaccatcacgcctggctaatttttgtatttttagtagagacagggtctcaccatgttgaccaggctggttttgaactcctgacctcaggtgatctgcctcggcctcccagagtcctgggattacaggcatgagccaccatacccgaccaatatttatattcttaatataagatgtacaatgaaaagcacaaattttaagtgtgtattagctgggttttgacaaatgcatttacccaaaagcctgtaacccaaagcctcatcaagataaagttacctctttgtcatagtgttctttcttttcttgtaattatttaattatctgtttcccccattagactttgagttccttaaaagcagagaccatttcttattttcctgctacctgtgccccgcactgtgccttaacacaataggtattctataactgttgtctggctagaagaataaatatgtactttattcctggaatattagtatgcgactttatacattctcttctctcacctttcacatccagaagttagcttagtcatgtcatgtttatgccttaagtacttctgacttctacatccttcattccttttccactgctgcagttctcagagatctgtcatctgaaccattaaaataaccttctaaatggtttctttctttttttcaaagttttaaactttttatttgcacattttaaaaattatgcattctagtaaataaaatcatttgaaaaaaaaaagaatggtaaagggttttttaaacaccaattttttactcccaagtccaccttccaaatgagtaacaaagtaatacttatatttatttttcttgagacagggtctcactctgtcgcctaggctggagtgcagtggtgtgatcacggctcactgcagcctcaacctcctgggctgaagccatcctcgcacctcagcctcccgagtaactggaactgcgagtgtatgccactgtccccagcaaatttttgtattttctgtagagacagggttttgcagtgttgcccaggctggtcgtgaactcctggacaaagtaatacttataaaatccgaagttggtcatgtttccatcctctttaaaaccttttatttgtttcccattgtctacaacagattttaatctgccttcttttaaaagcataggagctttttaaaaaataaaaccttacaacaaattctaacatttgaaatagatttaaaaacattttaaattcatgtaaatttataagttcaaatgtataacattaagtcaatattaaagccataagaatattataggtatgtttatgagcacaatttctttgtttttttcttaagacaaaatctcactgtcacccaagctggagtgcagtggcacaatcttggctcactgcagccttgacctcccaggttcaagtgattctcccaccccagcttcctgagtagctgggactacaggtgcacaccaccacgcccagctaatttttgtattttaggtagaggtaggattttgccacgttgcccacactggtctagaactcctgggctcaagcaatccacccgcttcggccccccaaagtgctggcattacagacatgagccaccatgcctggccattattattcttttttttaatttcaatagtttcagggtataggtggtttttggttacatagataagttctttagtggtgatttctgagattgtagtgtgcccgtcacctgaggagtgtatactgtacccaatatgtagtcttttttccctcacccccatcaaacctccccctggcctgagtccccaaagtccattatgtcattcttatggctctgtgtccttgtagattatccaagtttttctactccattaataataacttaaatatagatagccctttacaaatcacatttgatttttatcccagtcccattaggtaagatcggtattttccctgttttatggataaaagaaagtttcagtggctagttcaatattatacacattggtgaatggcagaggcagaattttaactaagattctctctctcctaatgaagtgcctttcctactctatcccctatcgctggttgcctctatatgttttgtgatccatttcagtaacaatcattccctttctctttgaccaggcagaccatctatcataccatacttctgtttttcaccctaatttactcagccattctacctgctttaggcccatacatattttcttcacacgtagagcagggtttcccagctgtggcaccgttaatattttggatcaaataattgtttacggggaaggaggctgtcctatgcattgtaggatgttttacaacatctttggcctttacccgatgaatgccagtggcacacataccccactcctaagttgtgacaaccagaatgtctccagatattgccaaatgtcccctatgaagcagaattgcccctagttgagaaccactgcatatagatctacatttctctcctacctcatttttcttttttcttacaaatatgcttttatattccagctgtaaaacccattgtaatgtgcctccatgatagctgtgaagttatatttctcttttaaagttaaaatctctcctttattatttatttgttgccatagtgaacaaacacccaaaggtattgagtagcatttttgactctccttacttgatctgttctcattcttacagagaaaactacttcatttttcttcatagctgtccttaatcagaacttttaagtctctgcaaatatgttcttccccatctttgtgatatatattccatctttgggaatcatttatcattttaatgtcttaacaggaaatcaaatcctgttttgtggtgatttatttcaagagaaacattcatgtctcttatctcctttctattcttgagccccaactctcatttgaagaagaagaaaaaaaatgcccactttatccttaagtctatggttcttgcttggatcattgccatagattcttctcagggtttgtctggaattttgttttgctcctatatgaaactatagatggaagttttgctcagcagctttgaaaaacctcagcagtctctcctttacatctagttgagatatgggccaataaaatagcacaatgttttgtttggctaaaaagagaaggaaaagacaggaatggactaacataggatttagtacaggtattagcaggcaggtttgataaatctcagcaggctttccttcatatcctagagaggataagcagtacccattccagttggtaataagaggaaaacaaagggataattgagaaaattatttttgttttagattagggagatttgagcgtgggtgtaggctgaaaagaaggaaatagtgaaggaaaaaaataagtggaagatctaagagagagggagaagctaaaggatcagggtcccagaggaaatggaaggaatagaaacagaggcagaaggcaggaccttgaaaacaaaggcagctatttcctctgaaacaaggggaaggatgaaggaataagtaatagcaaaagaatgaatgtgaggtgaggagaggggaggttggggagcccttgtggataactttcatctctataaagtatttggtgaaatcatctaccaatagaaagtgaagataggtttatattcttaaaaatgatgagtctgtataatagctgccatggtgaattagattagttagattagaaggttagtaaagtaggaatgaggaagaaaagatgatcaattgaccaagggttcagctaaggttaggtagcatgtttatagtggatctcatctgtttggttatgctgtttcttcagtattgtagcctacaaataaacatacacgcacacagttggtttaacctatggttgagaattgacatggtgagaatggtagaagatcatatgtccagtgagttcttaggaaaacgtaattgaaattttcaaccatagggttcagagtaagagttgaaggtccagaagaggctgatctactgacagtattagaaagtgtcagtaaattggtagtccaaaaaaagggtgaagaacaggatccaaagaaatggaaggatagtaggatgcagtcaggaatttcgagttcaggatctcataaatataattgtttcatgttcaaaagatggctatataaaaggtagagtagagctaacaataatgataccatttgtgctgctataacaaaataccttagactgggtaatttagaaacaatataaatttatttcttacagttctggagactgagaagtccagggtcatggtgccagtagaatcaatgactggtgaggacagacatcctggcagcctcacatggcagatggggaaaagggataaacggtgtgtccccacatggcagaaggggcagaagggcaaaagcaactagctaattctctccagtcctcttatcaggcaccaatcccatccatgaaggtagacatttcatggcctaatgatctcctaaacgtcccacctcctaatactattgcattgggggctaagtttcaaacgtgaattttggaggagacgcaaacatttaaactatagcatgatttatttatcatttaactttgcttcatatatagtatcttaattaattccctaccacaacccaataaggtaggtagatttgcctcattttataaaggaacttaacccaagatcatataactagtcagtgacagagccaggattgtaagctgtctattttaacaccaactatgcacttaaccattatactatatagcttttccacagtaagcctaataatgggaagttaattgcttcagcagaacttcagaggttattacagtgtttaagaagtaaacctcagaattaaccaaagtggaaaataatctttatcttttttaaagctacagtaggaaaggtatttcactatggtataatgaaaagagcataggacttgactaaaatcttgagatagaatctcaggcctaccatttactagctgtttgaccttaggcaggtcatttaacctctgagcttctttctttatctgtaaaatgagaatgataataaaaataatgatgatgatatggtaaaaaaaaacctgttcatccaatttcacagcattaatttaaagattatcataatggatataaaaagtaaataactatacagatggttgtcatggtgatagttatttatctatctgctttgtttccatgggaaagggcaagaagtgccagtggactcaatcatacatatccaacatttggacctttgtcctttacttaaagaggcactccaaaaagtgaacaagattaagaagttttctcaagattgatgactcgatatttttatggggtctttatttcttttctctttctcagaagaaacataggtatatgttggatgcattaccaagcaatttaaatttcatttcctgctattaggtattaatattaaccgaggcctcctatgcttgggaaatgtaatcagtgctcttggagatgacaaaaagggtggctttgtgccctacagagattccaagttgactcgactgcttcaaggtaagcccaaagtgcctccaaaaataagagagtaactcaaaatgatagtgctgagacagcaaagatgaaataggtaaaaagccagctatttggactatgacatacacagttgtctaattgataaatacgagagagtgctgttggcaagcaggtttctaagataatggaaaaatatcttcatatatgacattgagagccaagaaatctgtagtgcaccaactgtactttgtactttacacctgaaagtgaatttggttactgtttctttaattattagtgcggctaagcagaattccctggagagttaaaatccacctagagggggcatcctaagaatgtttaattccactagtggctcctaacttacttaggccaggccccagttgttttaacctgattaactgctgaaatcacaatcccttttgagaaaggggacacatgcaataggatttaaatgtatattacatcagaaatcttagatatgtatacatttcctattatttcaatataaaaaacactaagaactttttcttatagctctgaattttaagtcaccaacccgaatggacggctttgcttatatcctacttgtttgatttcatttcctttcgttattctttattgttctttttcagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtataagggacttaaagtttgatgggaaaaattacaagtatgtgagtggaatgatagagcttctgttttcagtttcttctttatcagaagtttagagatgttggttaggcattatgtttgttcggggacctcttaaaataactcctattaacgtgtttgctgtccatttaagattgggggtagcattggaaagttcactgatgaagaagtgagcagtgagagatgagatgagaggtgtagacaggggctaaattctgaagttccttatatgacttgttaaagaatttggaattcaacctgaaagctatgaagagccattgaagagttttaagtaggagggtgatatgataaaatgtgtgttttggcgagatcattctagcaggtatagagaaaatagattagaagtgggcatgactagaagaaggaaaataaatcactgcacaaaacaaagagagttctagagagaagaaacataggtagcaaagtacagttgattctcgaacaataggagtttggtccaacaaaacacagatcaaaaatacagtatttgcaggatgagaaacccatgtgtagactttttatacatgtggattctgcagggctgaccgcaggactggactatgcatctacatttttgtatacgcacagggtcctggaaccaatcccctgcatatacataggaacagctgtatagtggccaggagcactgacactgcaattagcccacccatgttcaaatcttagctctataactcactggctatgtaccttgggcaagttctctgtgccttggtatccctatctgtacagtagaaataataataataccttcttcttagggtttttgtgagggttaaatgagttaatacatgtaaagcacttagaacagtacttggcttatagcaagtgttggaagggtctgagataggacagaagtatagtgcatttgaagaactcaaagaatgccagtgtggctagagtgtagaaagcaaggaaagagtacaggcttaccttagggatgttgcaggcttggttccagaccaccacagtaaagcaaatatcgcaataaagtgagtcacacaattttttttgttttccagtgcatagaaagttatatttacactatactgtagtatattaaatgtgcaataccattatgtcttaaaacaatgtacataccttaatttaaaaatactttattgctaaaaaaaaatgttgacacagagacatgaaatgagcatatgatgttggaaaaatggtgccaatagccttgcttaatgcagggttgccacagatcttcaatttgtaaaaaaaaaaccacagtatctgtgaggtgcagtaaagtgaagcacaataaactgagatgtgcctgtattccaggatgaggctagagggaaagcagaggactgatccaggactcatggacaatattaaaaaggattttaagccaggtagtaacttgataatttacatttttaaacaatggcctggctgctgtatagaaatggattatagtagagcaagagtagattcatggagaccatttaagaaggtactgcagtagtctaagcgagagataatgatggcttggacttagagtgctggcagtggtgatagaaagaagtaaccaatgaattagataaaggaatgacacccagatttctggcatgtggaactggatattcactgacctgggttacactggaaaaggaccaggtttgaggataccagacaactaagtggaaatatcaggtagatagttgaatataaaagtataaagttcagaaagatctgtgcttgaggtaaatttggaagtcaccagtttcaggtaatagaaaccagaggcagagatgagacattcagaagagaatataaggagaatgtaagtaagaaaactcctactgagctttgggggactttaccatttaaaggacaagtggagcaaagatgaaccaagaaagagacttagaagatcagttagaagaatagaaggaaaagcaggaaaatgtgtcttgtaagccaaatgctaccagtcagtcagtcaagtaaaatgaagactggaaaatgctcactggatttggtgacatgcagctcgtttgtaacttgggcaagttatttcattggaacaatgtaggcagtcatattggagtaagttgaggagcaaccgagtggcgagcgaaaggaaatggaggcaattggtgtattattctctcaaactttgtgaaaaaagagaaaaatagggcaagagagataggaagtggggttggggaggatgcttttgtttttaagatgggagagacttgaacatattttaatctgaataggaaggatcttatagaaagggagaaattgaaaatatagaagagagaagggataacagtgtaagattcataagatggcaagaagagtgggaatccaaagcacatgcaaggagaccagtcttgggaggcagaacagctccccttgtgtcataggagggaatgggagaggatgcttacacttgcgctctggtttaagatccatctccatgaagcctccctttgactatttaggtttttgttaatttgcttattctgtcttgtattatttcctactattttagacttcaggcttatctttcttaagtagattgtaaacttgagagtaggggtcatattttatttttatatgtccgtacgttgtctagcccagtgctgagactgattttcaaaaataggtactcaaggccaggagcagtggcttacatgtgtaagccccgcactttgggaggacgaggtaggtggatcaattgaggtcagcaattcaagaccaggctggccaacatggtgaaaccctgtctctacaaaaaatacaaaaattagctgggtgtgttggcgggcgcctgtagtcccagctacttgggaggctgaggcaggagaatcacttgaacctgggaggcagaagtgccactgcactccaccctgggcgacagagcaagactctgtctccaaaaaaaaaaaaaagaaaagaaaagaaaaaagaaaaataggtgctcagtaaaaactcattaagatgtagataaaatggacaactcatcttctacttaatagttgttcatgtaatgctgattttcctgttatcattggatcatcaactatgtatgatgcctttggtagtatctaaggtatgctatctgccttagatttcatagacatttagtaaaattactttattgctaattgtggtaattttactgccaagggttaagtagcatttggttggtgactagctgattatttttctttgcttctcccaggtacaacagctacaagtcttgttgctacaggcccatggaggtaccctgcctggatctataacgtaagagtcatagattaatttgaattgtgtattctaatagaggctatttttcctaataatagtttttccctggtttctgctagcacttggtgtcacggtaaggatcttaccaattttgctgactatttaggacttagttatgtttgaagcagcctaatgtaacagaaagagcatgggttctggcctcagaaatttattaattggaattctattgtgaggaagagctgtctcttcttctccatttgtttatttgacatttagttatatttgtatagattcatggatatttattttattctatggtttaacatccagtactattatttgttttattgctcaaattgttcctgctttgtccattaggagctccttcaggttggctcttctcaagtttttgatcatttctacaagaggttccaaactcatcttgtattttccctaccccagttctggaatcaaccatgtctccaaggaaccctagttcctttctttttttgttgatggaaaattgtgtttagaagccaagatttgggtactagcgccagctgtgtttattgttaccagagttttactgcttctaagcactctgagcaggtagagctcagaaatatctacctgtgtagtaacgtacacatacactttcatctatatttttgtatatatctatctgcatatatattacaaaccatgagtttatactgacacctctgataccattccaatgtgacagggttcattttggctttccccctttccttatttgtaacttctttctccaacagtaagaaacccagctctcatctgcaatctatttatttacttgctcagttctactatacacataaagtagtttcagaattgttagcctatatccctgtgggaaacactttctatgaaatagattacagcatttatgtacagttctttttatctttaggcatagagtatctaagcaagataatgtttcccacagttactgtttgtattcccttttaggcactctccccctaaatcttagttacttttgtttgtttatattttaggtatgtgaaacataatggatctaagagtcagagttacacaaaaagatatactcagagcagagaaatgcaaattaaaaccccaatgagatatcacctcatgcccattaggatggctactgttaaataaataaatagataaataactgaaaataaaaggtgttggcaaggatgtgaagatatagagaaattggaacccttgtacactgttggtgagattgtaaaatgatgtaactactgtggaaaacagcatggaggttcctaaaaaaattaaaactagacttaccatatgatccagcaatcccacttctgtttatatatccaaaataattaaagcaaggtctcaaagagatgtcttcacgaccatgttcatagtggcactattcactatagttaagaggtagaataacccaaatgtctatcaacgtatgacctgataaacaaaatgtggtatatacatgcaacagaatatcattcagccttaaaaaggaaggtaatcctgtcacttgctacaacatgggtggacattgaagatatgctaagtgaactaagccagtcacaaaaagacaaatactgtatgattccacttatgtgaggtatctaatgtagtcaaattcatagaaacaaagtagaatggtggttgccggggactgggggataggtgggaaagggaagttgtttaatgggtatagaattttagttttgcaaaatgaaaacattctggagatctgtttcacagcaagcaatgtgaatatacttaacactagtgaacaacacacttaaaggtgattaagatggtaagttttatgtttatatgtttcccatgattttccaatttgtatttgtataaatttatgggatataagtacaattttattatatggatgtgttgtgtagtggtgaagtctgggcttttagtatatccatcacctgaataatgtacattgtaacaacttagaaagttaaatactggatgttctcacttacaagtgggagccaaataatgtgttcacatggacctagagtgtggaacaattgacattggcaactaggaagcataggaagtttgaggggagtgggtggtgagaaactacttaatgcatacatgtaccacaatttttttcaaaaaggaaaaaggatatactcagtgaggtaaatgtcattccctctccatccctgcaactctgttcccattcctatttcccacccttatttctacctcttttctaccattattctcgctacgcctgtatttaacccatctctttagtttctggtttagccttcttgtatttcttttgtacaaatgaacagatacctgtgtattttattatatcacctttttttctcatatgaatggttgggtactgtatgtaatgattgtatactctttgtagctttgctttgttcagtatttcctggaaatcatttcttaccagttcagagaagtcttccgcattcttttttgcaggtgcatagtacttttattgtggacatgtgccatacatatcaattcaccccccttcctatgtatgcacatttaagttgtttccaatgttttgcaattaaaaacatgctgcagtgaataacctgtgtgtatatatttttgtattgtcagaggtttatcttaagggtaaatttctagaagtgggattgctgggacaaaaggtaagtacatttctacctttataaggtattgccatatttgcctccagaagagatgtaccagtttgcattcctaccagcagtgtatgagaaagcctgtttccccacagcctcactaatggaatgtattgtcatactttttcaatttttggcagtctgataggtgagaaatgctatctcagtgttgttttactttgtatttctcgtattatgggtgaatttgagcattttttcatatgtttaagggccacttttatcccttttgctggtgaattgtccatgtcttttctcatttttctattgggttttttggtcctttggcctctttttaaaaataaattgtggtaaaatatacataacataaaatttaccattttaattattttaagtgtacaattcaatggctttaaattcattcacaatgttgtgcagccatcaccaccatccacctccaaaatttttttcatcttgcagaactgaaactctatacccactaaacaataactcctcatttcctctctcctcagtccctggcaaccactattctgctttcagtatgaatttgactactctaggtacctcatatgaatggaatcatacagtatttgtcttttcatgactgacttgtttcatttagcataatgtcttcaaggttcatccatgttgtagcatgtgtcacaatttcctttgattttaagattgaataatatttcattgtattttgtgtatccattcatccattgatggacacttggactgcttccatcttttggctattgtgaatgatgctgctataagcatgggtgtacagctaggtgtggtggtgcatgccgaagtcccagcaactcagtaggatgaggcaggaggattgcttgaacctaggagttcaaggctgtagtgtgctaaaatagcacctgtgaatagccactgcgcttcagcctgtgcaacatagtaatattccgtctctttaaaaacaaacaaacaaaaaaacatgggccaggcgtggtggctcatgcctgtaatcctagcactttgggaagcaaaggtgggcagattgcttgagcccaggagtttaagactagcctgggcaacatggcgaaaccctgtctctacaaaaaatacaaaattagctaggtatgatggtgtgcacctgtagtcccagctacttgggaggctgagttgggaggatcacctgagcccagggaagttgaggctacagtgagctatgatcataccacgcactctagtctaggcaacagagtgagaccctgtctcaaaacaaacaaacaaacaaaaaacacacacaaaacaagcaacaacaacaaaaaaactatggatgtacaaatgtctgatcatatccctgctttcaattcatttgggtatatacctagaagtaaatagctagatcatatggtagttctgtttttaatttttaaatcaaaccaccatactgttttccatagtggctgtaccattttacatctccaccagccatgcacaaaagttccagtttttccacaccctcaccaatgtattttttttataatagcaaccctaagtttggcccttatttttgacaattctttatatattcgtgatattagccctttgtctgtggtgtgtgttacagataatttctctgaatttatcagttgtcttttactttgtttatgatttttttgtcatataaaatgttatgatttttatgtagtaaagcttattaatttttttattgcctctggattttttcagcagctttattgagctaaaatttacgtaccataaaattcagtcattttatgtgtaccattcaatgatttttagtaaatttacagagttgtacaactatcaccacaattcaggtttagaacatgtccatcaccccaaaaagtttcctcatgcccatttgccatcactctcattcccactcccagaccaaggcaaccactaatctcttttctgcctttatagatttgcctattatagacatttcgtatacatggaatcatagaggatgtagtctttttttgtctggcttctttcacttatgttttgtggttcatccatgttatagcacgtgttagcacttccctttcttgcgtaatagtactccattgtctagataggccgtatttgtccatccatttaccagttgatggaggtttgggttgtttccactttttggctttcataaatactgctgctgcaaacattcacttgcaagtttttatatggacatgggttttcatggggtaaatgcctgggtatagaattggtgggtcatatgtttaactttttacgaaactgccaaactgttttccaaagtggctatatcatttacattctccccatgcctctggattcatagttagaaagcctttctccacaccagggttaaaagaggaattcagccgggcgcggtggctcatgcctgtaaccccagcactttgggaggccgaggtgggcggatcacaaggtcaggagatcaagacaatcctgcctaacacggtgaaacctcgtctctactaaaaatagaaaaaattagctgggtgtggtggcgggcatctgtagtcccagctacttgggaggctgaggcaggagaatggcatgaacctgggaggcggagcttgcagcgagccaagaccacgccactgcactccagcctgggtgacagagcgagactccatctcaaaaaaaaaaaaaaaaagaaaaagaggaattcacccatgttttcttctagtaataatgtcgttttatgttttacatttcattttggcatttggtatttattcttatgtatgatgtgagcatactttcaatatttttgttttcaattattcatttttttctgattataaaagtgactaattgcttctagtagaacatttagagaagtatagagaataaaacttaaagttgctataatttcaccacccagagatgactacctctttcttcctaattttccccctttagataatttagtctgggtttcctgattacattttattctcactatactcatttagaagcaattgacccatcttcctttcctttcagtttagcacaaaaagttccagacttctgattgtctagaatgtgctaaaggaaatagtttcagctgcaaaagtaatagattctaagaaacagttgatgaatcaaacaattaaacttaattgttcaatattttacagagaaataaagatgctccttttcacaagaatgtatatttatatttttagagacattttataaggcttgttaacaaaaagtacattttacatatatgaatgttttcactttttgtccttagattattttcttttgttttttaacatgtcattgaagcttttgtatttattttctgtgagtgtcggtcaatttgcacatgctcagtttacttgaattcctagccttggcaattaaatagcatgtgaaaacattggttttctgttatattttctttttcagtctgatttttgcctggccctagtcctgtttttgctttacttttaaagattttacccattacgtggctgtcctatatcacgtggtcctataatatatctataatcttgccaagaactcttttttttccttattactgtgagagcttttatatccagtattctctgcattcatatagtacctatctctgtagtcagcatggtagttaagagcatggactctgaaactagactgctgagctcaaatttcagcttcacattacctactagctgtgtggctataggttatttaacttctttgtgcctcagtttccctagttataaaatgaggataacagtagaacttacctcataggggctattgggagaacttaaaaaatttaatgtatgtaaagtatttagaatagagcctagcccataatgctatagaagagttaactattattaattatagtggtatttaaatattcaagcatttgcctcaaattacaatgaagaacctacttctatgtgctaaattttccttggaaaaatcaacagttaaacttaaatatgattttcccatttagagaaatcctggaaattttttagggaaataaaaaactatcgagttaaaagtatcattactttgaagcttgtcagcttacatgaatgacacatggaagttttcagtttaataaagaaataacgaaataacacttaaatttactaatagttttttttataatctgcattttaattgaacattccttcataagagtcttagtaaatgctcaacagtgtaatatgagaccttattgtgtggccttcctattaacttttgataaagtgccttctaagatcttctataaaaattgatggaggtcttaagatgggtgagagggcatctactctattcctgaagtccttttctatcctttattgagattgagaacagctgttccctgtcctttatttttctctttttcatagccttgacaactattcatttttcccctcagtcttcttcagatcaaatcttcatatttcttctgatctttttttaaccagtcctgttttccagtcttttgaacatttcatcccagtggattaaaacaaaaaacagccctacttcgtattggtctgctttactagtctggaactgatatcaagtgatatgtatacattccaaagtttcttacctatatgtattccttcaagctatttctgaccctcccttttcctcgtatttgaaatggacaccattgttgtcatgactcactctaagtaatttaaaattaatagacaaatgaacaagaggctatgggtcataagttccaagcaaagcaagcatttagaagggagcacttatttataaagaattgtgaaatgttttctgagtggccgctggtcatcatttcaactttttgacttctcaaatgctgtttccctaaactttacaataaatgggaaatatatttatgttgattaggttgaattttgaccctgagcagtgtcacttctacctcccccatacctctcccttctctacttccctaatctttaattagggattgagggtgggaagaaaagggacagaacatgtattttagctccagttagctataacttcatacctacaggacacaaacagaaaagatcctagccaagagccaagatagaggttagtcattcctgttgcaaccgtatctggctctgaattattacctttctccaaaccactgaagtacttcagagatgtgtttattgtacatccaatattctacctgactaggaggatagattgggttggacacacttttcccagacttttgtggtataattttgacctaatccccctacctatccaaaaggcctatgggatatatttttatccacctttgatataggtattatcaatcagatatttttctaatatgttatttactttgttttagtgtggaaccatcagagaatctacaatccctgatggagaagaatcagtccctggtagaggagaatgaaaaattaagtcgtggtctgagcgaggcagctggtcagacagcccagatgttggagaggatcattttggtaagcccccaagaataaactactagcaatctgaacatttactagctttagtttccagaatatttaacatgtatctcattatgagagacaggttatattgaaagaaatgtatttgtattaccatatcctccagggagcccctctggggtaaatatgtgggcttataatcaaacatacagaaaagttaaaagaattgtacagtgaacacctatgtatctaccacaaagaatctacataaatcccattttaaaatagattcatttaaaaataccagaaagtaaagaaccaagtacctctgtcaccttaaatcctgcctaatctttatccataataccaagtaaccattccttctccaagattttagttattttccatctctcttcccctaatgttgtcacatttcatatcccatactaacagctgccatggtgagatacaacagcttggaaattaattttaattcattttccatgtgattgatttccaaatagtggatcactatataactgattacacgagttctgactcctactacctgcttgtctgtcagtaacctcctggatcagtgcatgctgactctatcactaaggtttttctactagtctaaatacaactcaatctttgatagcacgactgttgccagaagcaaaaataagtttccaccaaaatataattgaacctctgtaatgtatacaccttcatgcatcagtgtgctctctagtcaaggaaagataagctgcttaaagatttctttcaagtgggctaaatcctacgtccattgtattgtccattactaacggagggtgaaaatgggatataggggatttttatatacagttttctgtctccagtgctgtatttatgctttgaagtaactctagaagctgtgtttcacatgtatgtgaatgaggctgttgtaacagaaactacttcttattctatccacatactcatccgacctttataaggttgttacagtgtctgcctgataggcttattgtttgatatcctgtcagaacttcataacaagcacaacatttttgtcctatataaacgattctttccagatctgttatagtatccagcatgttacagatactgtgattgaaataaaactgaaaatatcaatcacccttcccaaaacgtaagctgccttctgctgtttcttctttctctaccatcattcttgtgccgtaccctttttcttgctgtcttttgctaaaactagcctaccatatcaaatagtataacttaaaaaaaaaatctcagctcaaatttagtgtgaggcccttttatgttttaaatgcccttatgctggggctagggaacagcgtagtgtaggaggcagtttaaagtaagtggggttttttgtttgtttgttttttgtcttttttttgtttgttttttttgtttgtttgttttgcaaacagcagggactaacatgccaggaaatattgctttttcccctcagttgcaaagttctctatggaattaaggcttcacactccaccccatagtctgagtttcatggcaagcataaaacctagctgctcggatgctatttttagtagctcatgttgactgaagggctaatttccatgactcttttaaaaaacacatttttcactgaataaccaaagcccactaaatcctctgttacagcaaaggagacagcctctctacctagcttttaattcataggagtaggagagcataattatgtgaggctgtcaggcaccgccactgatgatctcctgggtctttgttgcagacagagcaagcgaatgaaaaaatgaacgccaagctagaagagctcaggcagcatgcggcgtaagttgcccaccagatatttgttagcaacctatagcatcttagtatataatcgtggagcctctggcctttgtcatatgaataacccttgggttctttttgtttgaattttcagctgcaaactggatcttcaaaagctagtggagactttggaagaccaggaattgaaagaaaatgtagagataatttgtaacctgcagcaattgattacccagttatcggtaagccaagtaggggcagtgtaaataggcatatcactttcatttgtttctcttgacacatacaagcctttctagctctgtgccttttgctgaaacaactagattgtgagccgcttttggacagaggtcgtggatcatttgatatgatctgaatattgagtttgttaaaacactcataggttacatatacaatgcacattagtatttcagtattctaatcaaataacagaagcaacaacatagcagtgcaaaattgcctaggtagcaagagcagcagtcattgatttgctgtcctcacagtgtaggctaacttaaaaagaggacttgtaccataccccaattttaaataagctaaattctgacagatagcttaaggcaaccagggaataccataagcctcttttataaccaataataagtaagtttgaatgattgttctaccataagttcccatttttgtttatttttagaaccattatagtagtggcaggtgtgttttgggggtggggtggttatttgttgtttttcccagaagaaaaattttcacaatcccactatccctaaaaatctatttttgttttggtgttccatctcttagtccttaggcatatatgcttttaaaaaaaacattgaaatcgtactataacatactatgttaagtggtaatggttggttttgttctgtctacactctgttgtttattattctgaaacagtgatgtgtatgcagatgcctggtggtaattcctagctcttgggcagagattttaattttaccagaaccatgagactgtagtccctggtcttgcccagtgttttctagagttgtcaatagtgtgtcacaaaattatccacacatagatttattcttgaagagaatattaaaaaaatgccatgcaatattgtcaggacttgttatgatggccagctctaagaaattaaatgagtaaactccccaaagactattaggcagtgttttagaataaggagtactgtaaagctatcatgagcagtccaagatgacagctcatttatccaacaaacagggtacagtaattgagagcctgggctctagagccacacagaccctggtttgaagccagttctgccacttcctagctatgtaatcttactaagtgctgtattactatcaaaaggaaagaatttaagtgattcaaataggggttaaaagcattattcatctgggcgcagtagctcttgcctgtaatcccagcactttgggaggccaaggtgggcggatcacctgaggtctggagttcaaaactagcctggccaaaatggtgaaaccctgtttctactgaaaatacaaaaattagccaggtgtagtggcatgcacctgtagtcccaggtacttgggaggctgaggcaggagaactgcttgaacccaggagatggaggttgcagtgagccgagattgtgccactgcactccagcctggatgacagagcgagacttcatctcaaaaaaaaaaaaaaaagaagaagaagaagcattatttagctgatgcactcagggtacacttgaactccaggtaacttcccaagtaaagcaagattggagctttatagagtaaagagaagaaagggttgtatgtccgtgtggtttagctcaggtaacagtttttaatgttaattgatgtgaaacttttggttggagattgtttcatttttttatacctcttcctcaggaatatactgatgcaatcctatccggataactgttattatattttgagagttgttcttacaagccttgtagtttctcagttggtcaaggttcacaggtgggagaggtggcaaaatagggataacggggaaaggaggcgagggttgaaggcaaggaaaattgggaatcctctctcgtgtgctttcttttatatcagcaatgtaagcaaagtgcagtgggatcataaaacaaaggatgattaactgttagtccagaaaattcaggaaggcatcatagaagaaactgggtcctaaaaatgaacaggagtttgccatgcagacaaaagggaagggacaggccaactctgggcacactgcttacgagttagccctgctccacaaggaaaaatttaagagcttttatataaaataaataaggttttttaaaaagggactagactatatatagaggaaaagatatagataaaagcaaagaggtatgaaagtttaaaaaatggtaagaacttcaatgtggctgaagtatagagtacttgttagacaacggctatcacaaggttaaatttcacaattataatgccactcaaatgcaactgaaacatctgatacatgaaaaccttgtgtgagctgcctcagaattaagataatctaggctgcagaagcccactggggccaaaacttacaagctcagaaatagtgacccagggtacccaccattgttcatggccatcacaccaatcttagaggattaataccacctcatttctggggcttcgagtcacatagaaaagatgaaggaaacccgtggaaccaaattaataaaataaagcatcctcagtgagaatctggcaatatgactggtgcctggtgtgcctgtagagggagttgctagtggtggctggctcagaggaactccgtagaatcgctgtgtctgccacttaaatgtacttggcacacacagtaggagggtgctaaagattgccacaaactgataaagttcctggcttccatccactgtcacagttaggcagagtaagcccttttatccaggagtcctgctggactcctgaatcagagttctccacatctattgttcggagaccctcccagctatatatttttttggaaatacacaacaatgtatcccatggcttttattaagactcactacagtgaaagcaaaatgtttcaaaagtaagtgcttgtgcccttcattctggattaaaactatttttattttaagtgactagtgaacacccccttttccattataaaggcaaccattgttcctagatattcttcctggggctttaagcgctaaactgtaccatttcttcctttaaaatataattcaagcaaacctccttgtgcagttacctgtgaggaaattcaagcagtcctttcagttcctacaaaatcaaatgatcttttttgtttatatcccctcctccaagaccagttccataaaaagcattttgcatgcccagtaacggtaccgcctacaaacacaaacttcatcttggaggatattgctggttaatgtagcacagtgtacccttgttcccctaaccatcacctttatgaaatcacgttttatttttaagaggttcttggttatagtcttagaatcgggggaaagagggctgtgagactgaaataaatcttattgtcatatatttacatttaggattatagaggcagaattctgccatgttcatgcagaacatgtcaccatagccctaagcttaaaccttagtattgtaaaatttcactgggccaaaagccaaagataaacccagagtaacaacatatcttcttcaaggattaacccatctacttttgatcctaactctggaaggtactagagaaagtctccaaaggccagtgttttaggccctaataatctaggacaggcctctgattagtccttatactgaaaattgaaacatgggagggaggaaagggtaaccattatagattttttttaatcctttttaagaatgatttagggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaagaatgatttagtatgtcctgcacttggagaatcaccagtactacaaatcatcatgagaaaggatgtgggaatactgaagcttcctttaaattctctttgagcctcactggttgggagtttctgagcagaataagggaaatgcttcataaatagcacttattaaggatctcttcaggccaggcgcagtggcttacgcctgtaatccaaactctttgagagaccgaggcaggtggaaccctggagcccaagagcttgagatcagcctaggcaacacagtgagaccttgtctctacaaaaaaataaaataaaatgagaccatccttcatgacatagtgagaccctgtctacaaaaaagttttttgtttttttgttttttttagtatttattgatcattcttgggtgtttctcagagagggggatgtggcagggtcataggataatagtggagagaaggttggcagataaacacgtgaacaaaggtctctggctttcctaggcagaggtccctgcagccttctgcagtgtttgtgtccctgggtacttgagattagggagtgatgatgactcttaacgagcatgctgccttcaagcatctgtttaacaaagcacatcttgcaccgcccttaatccatttaaccctgagttgacacagcacatgtttcagagagcacggggttgggggtaaggttatagattaacagcatcccaaggcagaagaatttttcttagtacagaacaaaatggagtctcctatgtctacttctttctacacagacacagtaacaatctgatctctctttcttttccccacatttccccctcttcttttcgacaaaactgccattgtcatcatggcccgttctcaatggtcgctgtctcttcagagctgttgggtacacctcccagacggggcggccgggcagaggcgctcctcacttcccagatggggcagctgggcagaggtgctcctcacctcccagatggggcggccgggcagaggcactcctcacctcccagacggggcggccgggcagagacgctcctcacctcccagacggggtggccgggcagaggcgctcctcacctcccagagggggcggccgggcagaggcgctcctcacctcccagacggggcggccaggcagaggcacttctcacatcccagacgatgggcggccgggcagaggcactcctcacttcccagagggggcggccgggcagaggcgctcctcacttcctagacggggtggcggccgggcagaggcactcctcacatcccagacaatgggcggctgggtagaggcgctcctcacctcccagacagggtggccgggcagaggtgctcctcacttcccagatggggcggccgggcagaggcgctcctcacctcccagacagggtggccgggcagagacactccctacttcccagatggggcggccgggcagaggcgctccccacttccctgacggggcggccgggcagagacgctcctctcttcccagacggggcggctgccgggcagaggcgctcctcactactcagaccgggcagccgggcagaggcactcctcagttcccagacggggcggccgggcagagatgctcctcacatcccagacggggtggtggccgggcagaggcgctcctcacttcccagacggggtggcggctgggcagaggcactcctcacttcctagtcggggtggcggccgggcagagacgctcctcacctcccagacggggtggcggccaggcagaggcgctcctcagttcccagacggggcggccgggcagagatgctcctcacatcccagacggggtggtggctgggcagaggcgctcctcacttcccagacggggtggcagccgggcagaggcactcctcacttcctagacggggtggcggccgggcagagacgctcctcacctcccagacggggtggcggccgggcagaggcgctcctcagttcccagacggggcggccgggcagaggcgctcctcacttcccagacggggcagccgggcagaggggctcctcacatcccagacaatgggcggccaggcggagacgctcctcacttcctagatggggtggcggccgggcagaggctgtaatcttagcactttcagaggccaaggcaggtggctgggaggtggaggttgtagcgagccgagatcacgccactgcactccagcctgggcaacattgagcattgagtgagcgagactccgtctgcaatcccagcacctcgggaggccgaggcgggcagatcactcgaggtcaagagctggagaccagcctggtcaacacggcgaaaccccgtctccaccaaaaatacaaaaaccagtcaggcttggcggcgggtgcctgcattcccaggcactcggcaggccgaggcaggagaatcacgggagccggaggcagggaggttgcagcgagctgagatcagggcagtacagtccagcctcggcaacagagggagacgggagagggagagggagagggaaagggagagagggggagggggagggggagagggagagggagctgggtgtggtggtgcacacttgtagtcccagctagtcaggaggctgaggtgggaagatcatttgagcccaggaggtggaggttgcagtgagctgagatggcagcaccgcattccagcctgagtgaaagagcgagactctgtctcaaaaaagagcgaggggagaggggtctcttcacttctcacattaaaggtactaaaagttaagtttcaacaactatgtaatgtttcataagggtgatatagagactccatgtactaaccctaaattcttagctgttgagctaatagctttttcacctatgacctccttaagtacatgacttcctggaaataattcttttttcccagggctttgaagaatcacttacacagaagtggtaatccatatcttacaataccaaataaagcctaaattccagtggtgagaacagagcttgctaatatgatagcctataaacaaattagtcctattaagtagtttagttttcccttctaggtggcatttgtttgaatgccccaaaaaataatttgccaaagaattagtgcttacccttttcctcctagttacctggagtagcaccatatcatctgttctttttttcccttttttctttttttctatttttagatttagggggtacaagtgcagttttgttacatagatatatcgggtagtaccgaagactggatttttactgtagccgtcacctaaatactgtacttcgtacccaataagtaatttctcatccctcaccatcccccaaccctttcactcttccaagtctccaatgtctgttattccactatgcccatgtgtacacattatttagttcccacttataagtaaggacatgcagtatttgactttctgagttatttcacttaagataatggcctctagtttcattcaagttgctgcaagagacatgattccattcttcttatggttgagtagtgttccatggtgtgactattactattccagtagtagtccatggtgtatcaatggatgatcagataaagaaaatgtggtatggtatacacacaccacatacacacttagattgattccatatctttatgatcagttcttatttacatgagggacagaggctgcagtacctttatctgacttcaagagcacacttttctgggagtacccatctaaggcatttatttctttctgttttttgtttttgtttttgtttttgttttttgatttttgttttttcttcaagatggagtcttgctctgtctcccaggctggagtgcagtggcacaatcttggctcactgcaacctccgccccccaggtttaagcaattctcctgcctcagcctccagagtagctgtgattacaggtgctcgccaccacgcccggctaattttttttgtatttttagtagagacggggtttcatcatgttggccaggctgatctcgaactcctgacctcttgacctgcctgccttggcctcccaaagcgctgggattacaggcataagccaccgtgcctggctaggcatttatttctttatagaggaagatcctgctaccttgactgactataaaaataaaaaataaccattctatttacttttctgatgcattgccattatttgatatgtctgttcgtagaatggtatgtccccataagaactggctaggcttgtacattaatagaggtatactaagcggtagatgcataaaaagaaagggtagagtccataaaatgggttaaactttggccttttggaatggctaaatgtttcactctggcccaaatgtctctggcagggcaggagaagtgcaagaaatatgtcagttgccacatgaccttattttttataagagctacacaattgtcctttatgaagaagaaagactcttgagagatgggaaatggaaacgtgactattggggtttctgtaactataaaatgggtccaatatcttaaacagtctctgtatacacttaaaaaaaattaaataaccaatataaaatccaccagtaagctttacttcagactctttccctaaaccaaaacatttgttactgcaggatgaaactgttgcttgcatggctgcagccattgatactgcggtggagcaagaagccgtaagtaattggcccctttgtgtagaaccaggagctctaactgccgtttcctataatttatcactcaactgaaaaagagaacctgtgattgttaccatcctccatagaatgcctgttaaatccagaaatctttagtgtaaatctcagcttcataaaatccctaccttggataggctctaccactaatagtataactggtaatggggggcaggacttctcaagaatgtaatgttccatatttgcaacccagctgactgatttcttgttagaggctagtattctgcatcaaccgtccagcaagttaaaaatgaggagaggaaaaaatgaggaaattatggcaaagtcaaaaaagcattagaggagaaacagaagagaattttttctatggatgagatattaggggctaaaagaaccaaggaaaataatttaagtgttcagatcacaaggatagataaaatgtgttagatgttgactaaaggttataaagacaaaatgaaaggctggatgatggattgcttgagacaggcttttctccctaaaatgaatctatgtcagtagttttcacattctgaaagaaggaaaatactaggtcaggtactagaggtcagctgtgtgagaacaaatgaacccttttctcaatttccaggaccttctctcctgtaagaaccccttggaatgaggtaaaagtaagaaatgccatccagatcaataaaggaaagagcaaagaaagttagttgatactaaaagagtccattaaagtatataagaaataaggtgcttgagagagcagggaactaggctagctatttatttcagatacttaaaacaaatgtatgcagagccactgttgtaaaggaacagagatattgttaatggagaagtgcctgtgagacttgatgaaatagtgcctaaggaactccatttgcttgtttctcttataaatcattatcctgatttttttccagcaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggtaaactatttcctagggcagtatttgttcatgtctacagtctcttaaactgaatgggaagaaaacaacaagcatataatttttgatgatgaaaagacaacaaaatgtatatagtataatgggagttgtactgttggtttaaaaagaggatacattcaggacagggagcatgtaattttgttccatttaatctaatgccttaccttatgccacaggtatttaataaatagtttgataacattataataaatgtggtccctacttatagagaaattatattctaataactatgcttggattctgagaaaaaacacatcttttggtaaatagtctgggttatagtatgaattatgaagacactagtggatgtcacatgacttgacaaatggctaaacttttttctgatgatagttctaagtggcctttgccaattaatagtcaggtctttacttaaaggcaaatccttggctttcaggttacccacaagaaatggcccttgctccagacttattttcccttgcagaccagtgtttctcactgtttgtaattacagacaaagggatattaggatgggtggtagggggaagaatgggttgttttcctgtccagctatatcctactactcccaaggtattatgtgtttatattgaggaacagctctagtatccatgctttcttattcccccatggcaactgttcatatgacatactttatttccaatctacaaccattaaaaacactttattactttacactgtacagttgttctcacatctgaaataagacacaggggcagggagagcttttggattggactgcagttgtcctagcaccctatctatcctgggaagtagccttttgaagacagaagtggggaggagagaacagtggacaagagaggtggacagttggcccaaggatgcccttggtcccttccctcctgagggccttttccaggggatcccccagggcccacgactgcaggaccttcaccaggaaaccaggctgaatgggaagagggttcacagtattggcgggggctgggaagtggggccaggatgaggaggaaggacagcttctggctttcttcccagctgctgggggttggagctgttttttggcactgtctacaaggtcttcctggggttgggaggaggaggaactgggggtttaagattctttccttgtggagttaggattctttccatttgaagaggggccatctggtctatggtgaggttcccaaggcataaacagtcagggtcttctgcctcctgcctccccaggacttccacccctgcctggctggcatcatctagacagccttttgtaaaaccaagacaagtgagagaggtgagcagagctggaaccaagccaggagcagggaaagaaaaaaatgtatgctttctccaggccctccaatttatcttcctcttccaagaggagagactatagggttggtttttgttggtggtggttcccaatctcagaagtccagatgaggctagtgttttctacctgttcttggtctagacagccccagtccctccccaggctacactaatggctggcctagatcagtagttggcagattctcatgcatgtcagaatcatccggaaggctccttaaaaccccagcttgcagggccccattccataagctctaattcagtgggtcttgggcggggccaataatttgcacttctatcaagttcccaggtgatattcctgctgctggaatgcaatacgagaaccactggcctagaatggtgcccacagtcacatcctcagcaacctggtgtctcctgggcagtactaaggagctgggccacagctggcaaagcccagccttaggggtaccaacatcacctgggaagctgctgggaatggtcttggggtgagcgcccggtgcagagaagtaaactaaggcacagagttcagcggcagagctgggagaggagcaggataccagggcccagtagagaacggatggggctgcaggaccctacaacaagtactcatgctttttttaaattgccagctctcatacgttttcagagtaaagacaaaaaaagtgtttctgctaattaattttcaccactttttccccctaggttagaggttgcttccaaaataataactgagttgccaatagagatttttttcccttttgttatcatggtcttttttaacttttaaaaacttagttttttgtaatgccagcactttgggaggctgcagtgggcagatcacttgagcccaggagtttgagaccagcctgggcaacatggcgaaaccctggctccacaaaaaatacaaaaattagccgggcctggtggtgtgagcctgtagtcccagctacttgggaggctgaggtgggaggatcacctgagcacagggaggtggaggctgcagtgagctgagatcacaccactgcaatccagcctgagtgacagagtgagaccatcccaacaaaaaaaactttggctgggcatggtgctcacacctgtaatcctagcactttgggaggccaaggcaggtggatcacttgaggccagaagttcgagaccagcctggtcaacatggtgaaaccctgtctctactaaaaatacaaaaattagctgcatgcctttaatcccagctacttgggaggccgaggcgggagaatcgcttgaacccgggaggtggaggttgcagtgagtcgagattgcaccactgcactctagcctgggtgacagagtgagaccctgtctcaaaaaaacaaacaaacaaaaaacttaatttttatctatgtcaaacaaatgcatatatatcattttttaaagtcaaatactataatacttagaaaaatcaaagcagtcctctattcctattctgacatttacctccatatttctagataagaattggcagtataattatgttacattttttagataaatatctattgacctcccatgatggaagacaagaacgtagctctcttatcccaccacctgtgcacactgcctcaccttcttctttcaaaatggttatatcaccctttttgtttaaatgagtatttagtgtttaaatttttctgattacataaatatgtttaaaattgagccatatagtatgattgcatttcctttcttgtatagctctttgtatttgctagagataataatctcattttttccatttacttagttttcgatatacctgtcaataattttatctccaaacttcttgacaaaactgtaaaactcatcccagcactttgggagcccgaggcgggcggatcacgaggtcaggagatagagaccatcctggctaacacggtgaaaccccgtctctactaaaaatacaaaaaattagccgagcatggtggcgggcgcctgtagtcccagctactggggaggctgaggcaggagaatggcgtgaacccaggaggcggagcttgcagtgagccgagatcacgccactgcactccagcctgggcgacagagcaagactccatctcaaaaacaaacaaacaaacaaaaaaactataaaactcttcattgtggtcagacataccagataatttatcaatccatttctttcctgaaaacaaccgttctggaatcttctgtcctggtttgctttctctagggctgttgcccactcaccagtttgggaccatcatcctggggatttgcttcacttctttctcatctgtgttgacatggatttcatgtcttcctcctctttagtatacccctttgctttggtggagtaaaaccccaatagctttctgagaatgtatacatgaaagggaaatactttaaagctttgcatgtctgaaaattgctttttaaaaattcttttacttgttagtttggctgggtttacaattctatagaaatgttttcttcattattttgaaggccttgctccattgtcttctgtttccagtattgctgttgagaagtctattataattttggattatttgttatagacctatttttttttactttggaaactttcaggatcttttcattgtccccaggtgttacttaatttcacaatgatggaccttggtatggtttcctgttgtttttttgttgttgttgttattattgttgtttttatagagacagggtcttgctctgttacccaggctggagtgcagtggtgccatcacagctcactgcagcctcaacttcctgggctcaggtggtcctcctgcctcagcatcccaagttgctgggactacaggcatgtgccaccatgcctggctaattttttattttttgtagagatggggtctcactatgttgctgaggctggtctcaaattcctggtctgtagtgatcctcccagcctcccagtcctaaagtgctgggattacaggtatgtaccaccacacccagccttcttttctcgtttattgtgcttggtgctcgactggtcctttcaatctagaaatttgtactcctttctgggcggtttttttcctatcatttctttgataatgctatctctacattttctctgttttctctttcttgcacttctcttagtcagatattggacctcttagatttagtttctgcttttctgatctctttcttcctattttctatttctttgtctttttattccactctgagagatttcccttcattcttagtgaattatttcatttggctattaatttccaaggtctccttttgatcctgtaattgttccttcttatagccttttattctttttgtgtggatgcatagcccatctctaagaataggaattaaattttatcaaggttttcttcttctccctgccttgcctttgtttcctccagatttcctttctctactgtgtttgttttggtctgtctttcaggtaagatactttcctacaatttctagtgagccatggctatccattcatatttaagagggaggcactaaaagccaatagcaagttgtatgtgcatggatttctcttaggctagtcaatttccaataaagaaatcttttattcttttgcctagagttgtatgggcctagtggtggtatgccatcattctagtaacccagacaaaataagggagttgaagtctctccaatcatagacagacttttatttaatccctgtcagcagtatggtactgcatccctgctattagctgtgtccaacctgttaggttcggcctctccagaaaggaagcctctgctctactctgtggctctgtggtacatattggcatgcttcttcttgatgtttgtcctgtaggagttatattttagctttttccactctggatgtcagttactgcttatccagctgttttcttcttccaaaagtttgttgatatctctcaactgctttccttgtctcttttcattctcgttgatttatacctccttttttgttcattttcatgtgatttcaggagggagtaagttaaatatgtagctcaattgtccatgttaataggacatacaatgcagcctctttaaggtcaaatgtattttggcttttccaggataaacaaaggattactggtaaggctgagaagtgattcctcctttcttgtactcttgcctagaaacatggggatatgtgttcccccactgtatttctttctttctttctttctctctctctctctctctttctttctttctttctttaaccggagaggggtatatttattttctcacattttaaaaaaaaaaaaaaagctgaacataagtagtctggggcacgtacagcagcaaaggcccaggatccttcctgctttctgcttccttggccttagggtgtgaatcttttcctcatgctctcaagacagctgtctgagcaccagccatcacatccacattccaggcaggaagaaggcaaaggtgaagggtactgcacatgtcagctgagctccctttacaggttctttcctgcaagtctctcccgacatcatccacttgcatgctacaactgcccaccctgggttgtgagggagggtaggacatggcttttgcctgcccgcttgtcagaattgggcagaagcactgggattctgttagtagggaggaaggagaatagatgctgggttaacgatttgcagtccccgccacagccaggacttaggcaggggtgattcccactaaaagccaaaggtttcatgcctggctgcaggggagaggtgcttgggctggggtcctgccttgtcttaacaaatacgaggctcttgttaaatatttaaccctgtgagggtggcttgtggcccacgtgcacccgaatcagctgcctggcatgcctcagcccactccagggcttccaattcaccctggggcaggggaggcctggggcacgcggttttcacacacacactcctagctgatttctttttcttctgtaatttataaaattaacactgcacttattggaagacatgaaaatccaaagatgggtagagaaaaagttcacctccctgtgccttgcccctgactaacccacgttaacagtcttacctgctcccaggggattctgggatcatggaaggtccttgagaaactctctagtcctagacaagtgctggggggtgggaggataggctggggagagaagggggctcctcagcaggccgagccttggttgctcaaccctgctggtactgactacacatggagcgaggaatgtgctgagggctcagccacgtgggtggtccttgtggcctctgccactgccctgggtagtcgtcactcagccacgtcaacaagcgacattggggaggcaggcctgggccgcctgaaccgtcacctcagtcctggttgacacctcaggcctggtcattatctgaactttggctgcagggcttctgggcagaaagggcagatccaactggctcgtcctagccatgtgctcccggagcagcctgcccagggatctggagagcagcagccagatcctaacctactctgcaccaacaggcaggaaagggcaccttgagtctgccactgtagggtttcagaagcaggctgacctgaggctttccaaatttcacgagggctccttctaaggcctgggctgtgtccagatgttggaccacatgcaaagaatggaggccgagtccagaaagaggagggccctcccccatgggaatgtgcacgttggaagggctccccatttgcccctagatcctaggctggatgtgggctcaggaggctaacccctatggaccagcccacccgttcagccaatgggcagccacagcaagggcagagggagcagcagaggcagcccacgtggtcacaggtcccgtgggctccagagctctcagctccaggcacccctgcctgccccgcttcgagcctattgggggcagacttcctgctgtgtctggtcactaacctctgcccacaccactaaaggactgtagctgaattctccttagttaaatcctctgctaacacaaaaggaaaaagccaaatctcatctcacaagagctttatttgaggtgcagcatgcatggggccttgccccaaatgccatgggcatcacattcaggaagaggcagacatccccacaacagtcacatgctgaagcttccgtctgcaatgtctggtggcagagttctcactcagcagacctgtatcattatatacatcaccatgttatcaaagtccctggactggatattgtccccgggttacagaaggggttgcacatcacatctatgtaggagttgtgcagcttccagaacatcctgtgaatttcattgtctcgaagagctgtgttggaggaattcaccaccatgacaaacttcaccttggagatggtagtgtagccctgtctgcatagctggttagggaatgcacttgtaagacaaggactgctgggacagcaggtaaagaacctgccagctgagggccctctgtgtgccctcagtttggagaagcctggcaaccttgaatcacaggaagtgcccaggctgggctggtcctgcagtgaccatactgggtgcatgcctacatacttcactgggatgactggtgtttactggagaagcaaagggcaggcagctaagctttacccaattctggctccggaagctgagccattcagactctgagtctctgtgtgcacctgggatgcctcaccctctttgtgaatcaatgcctggtccagaaagttaactgcaaaaccagagacttcatgaataaggcggacctcctctgtagaggccatgttttgtaaaatagtggctactggtaaatgtcaccatggacaagctacattactgctcttggaacgtctttgaactccatggtctcaagtgatttgtccaaagggactggtcgagagtctctagtgacttatgaggcaagaccttgtagtcctctgtggggtagagcaggtccagatagacctctctctggttgaccaaggccttccccattgaggagatcttctcatccaccacatccagagatgtgtgcaccatgtactggaaactcagctctttctccgtgggggtgctgcggatgtagagagggtaattctccttggtgatcaccgggatgcatatcaccatcttgggaggaccagtgctgggtgccccgcccattgtattcctaactctacaaaggggtgctagtaaggagctatagctatagtaagagatctagtctttttccccatggcatctagtccttttccccatggtatcaaatatgcttgattaacttaagaagaaataaattttttttgagacagagtcttgctctgtcacccaggctggagtgtagtggcgcaatctctgcacactgcaacctccacctcttgagttcaagcaattctcctgcctcagcctcctgagtagctgggattacaggcctgtgccaccatgcctggctaatttttgtatttttagtagagacagggtttcaccatgttggccaggctggtcttgaactcctgaccttaggttatctgcccgcctcggcctcccaaagtgctggcattacaggcatgagccactgcacaaggcctgaaataaattcttaatataatcaatatgttttaatcacatgtgaatcaccatctttttttttctctaagaaataaaagcagtttttaattcaattatttatttatctagagacaaagtctcactctctcgcccaggctggagtgcagtggcatgatcatagctcactacagccttgacttcctgggttcaagggatcctcccacctcagcctcctgagtagcatggtatttttcctatcacctgtaaagaattgccaaagaaaaatagggggagggataggttctgattaatgaagattaccatgagttgtagtaaaccaggactcaaatttttgaataattcccccttgtggagttggtaagacaattagggactaaatgtggtgtatataatgaatagaaactatttttctttttttttttaattatactgtaagttttagggtacaggtgcacaacatgcagctttgttacatatgtatacatgtgccatgttggtgtgctgcacccattaactcgtcatttaacattaggtatatctcctaatgctatccctcccccgtcccctgaccccacaacaggccccggtgtgtgatgttccccttcctgtgtccatgtgttctcattgttcaattcccacctatgagtgagaatatgcagtgtttggttttttgtccttgcaatagtttgctgagaatgatggtttccagcttcatccatgtccctacaaaggacatgaactcatcattttttatggctacatagtccatgctgtatatgtgccacattttcttaatccagtctatcattgttggacatttgggttggttccaagtctttgctattgtgaacagtgctgcaatagacatacgtgttcatgtgtctttatagcaacataatttataatcctttgggtatatacccagtaatgggatggctgggtcaaatggtatttctagttctagatccctgaggaatcgccacactgacttccacaatggttgaactagtttccagtcccaccaacagtgtaaaagtgtccctatttctccacatcctctccagtacctattgtttcctgactttaatgatcaccattctaactggtgtgagatggtatctcattgtggttttgatttgcatttctctgatggccagtgatgatgagcattttctcatgtgtcttgtggctgcataaatgtcttcttttgagaaatgtctgttcatatcctttgaccacttgttgatggggttgtttgtttttttcttgtaaatttgtttgagttcattgtagattctggatattagccctttgtcagatgagtaggttgcgaaaattttctgccattctgtaggttgcctcttcactctgatggtaatttcttttgctgtgcagaagctccttagtttaattagatcccatttgtcaattttgtcttttgttgccattgcttttcgtgttttagacatgaagtctttgcccatgcctgtgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttgctgtagccttgtagtatagtttgaaatcaggtagcatgatacctccaactttgttcttttggctgaggattgacttggcaatgcaggctctttttttgtttccatatgaactttaaagtagttttttccaattctatgaagaaagtcattggtagcttgatggggatggcattgaatctataaataaccttgggcagtatggccattttcacaatattgattcttcctacccatgagcatggaatgttcttccatttgtttgtatccccttttatttcgttgagcagtggtttgtagttctccttgaagaggtccttcacatcccttgtaagttggattcctaggtattttattctctttgaagccattgtgaatgggagttcactcatgatttggctctctgtttgtctgttattggtgtataagaatgcttgtgatttttgcacattgattttgtatcctgagactttgctgaagttgcttatcagcttaaggagattatgtgctgagacgatggagttttctagatatacaatcatgtcatctgcaaacagggacaatttgactttctcttttcctaattgaatactcttcatttccttctcctgtctgatttccctggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacgtcccatcaatacctaatttaatgagagtttttagcatgaagggttattgaattttgtcaaaggccttttctgcatctactgagataatcatgtggtttttgtcattggttctgtttatatgctggattacgtttattgattttcgtatgttgaaccagccttgcatcccagggatgaagcccacttgatcatggcggataagctttttgatgtgctgctggattcggtttgccagtattttattgaggatttttgcatcgatgttcatcagggatattggtctaaaattctctttttttgttgtgtctctgtcaggctttggtatcaggatgatgctggcctcataaaatgagatagggaggattccctctttttctattgattggaatagtttcagaagcagcggtaccagctcctccttctacctctggtagaattcggctgtgaatccatctggtcctggactttttttggttggtaagctattaattattgtcacaatttcagatcctgttactggtctattcagagattcaacttcttcctggtttagtcttgggagggtgtatgtgtcgaggagtttatccatttcttctagattttctagtttatttgcatagaggtgtttatagtattctctgatggtagtttgtatttctgtgggatcggcggtgatatctcctttatcattttttattgcgtccagtctatttgattcttctctcttttcttctttattagtcttgctagcggtctatgaattttgttgatcttttcaaaaaaccagctcctggattcattgatttttttgaagggttttttgtgtctctatttccttcatttctgctctgatcttagttatttcttaccttctgctagcttttgaatgtgtttgctcttgcttctctagttcttttaattttgatgttggggtgccaattttagatctttcctgctttctcttgtgggcatttagtgctataaatttccctctacacactgctttgaatgtgtcccagaaattctggtatgttgtgtctttgttctcattggtttcaaagaacatctttatttctgccttcattttgttatgtacccagtagtcagtcattcaggagcaggttgttcagtttccatgtagttgagcagttttgagtttcttaatcctgagttctaatttgattgcactgtggtctgagagacagtttgttataatttctgttcttttacatttgctgaggagtgctttacttccaactatgtggtcagttttggaataggtgtggtgtggtgctgaaaagaatgtatattctgttgatttgggatggagagttctgtagatgtctattaggtccgcttggtgcagagctgagttcaattcctggatatccttgttaattttctgtctcattgatctgtctaatgttgacagtgaggtgttaaagtctcccattattattgtgtgggagtctaagtctctttgtaggtctctaaggacttactttatgaatctgggtgctcctgtattgggtgcatatatatttaggatagttagctcttcttgttgaattgatccctttaccattatttaatggccttccttgtctcttttgatctttgttggtttaaagtctgttttatccaagactaggattccaacccttgcctttttttgttttccatttgcttggtagatcttcctccatccctttattttgagcctatgtgtgtctctgcacgtgagatgggtttcctgagtacagcacactgatgggtcttgactctttatccagtttgccagtctgtgtcttttaattggagcatttagcccgttaacatttaaggttaatattgttatgtgtgaatttgatcctgtcattatgatgttagctggttattttgctcgttagttgatgcagtttcttcctagcctcgatggtctttacaatttggtatgtttttgcagtggctggtcccagttgttcctttccatgtttagtgcttccttcaggagctcttttagggcaggcctggtggtgacaaaatctctcagcatttgcttgtctgcgaaggattttatttcttcttcacttatgaagcttagtttgactggatatgaaattctgggttgaaaattcttttctttaagaatgttgaatattggcccccactctcttctggcttgtagaatttctgccaagagatcagctgttagtctgatgggcttccctttgtgggtaacccgacctttctctctggctgcccttaacattttttccttcatttcaactttggtgaatctgaccattatttgtcttggagttgcttttctcgaggagtatctttgtggcgttctctgtatttcctgaatctgaatgctggcctgccttgctagattggggaagttctcctggataatatcctacagagtgttttccaacttggttccattctccccgtcactttcaggtacaccaatcagacatagatttggtcttttcacatagtcccatatttcttggaggctttgttcatttctttttattcttttttctctatacttatcttctcgcttcatttcattcatttgatcttccatcactcataccttttcttcaagttgatcacgtcggctactgaggcttgtgcattcgtcacgtagttctcgtgctgtggttttcagctccatcaggtccttgaaggacttctctgcattggttattctagttagccatttgtctaatcttttttcaaggtttttaacttctttgtcatgggttcgaacttcctcctttagctcggagtagtttgatcgtctgaagccttctctcatcttgtcaaagtcattctccgtccagctttgctccattgctggtgaggagctgcgttcctttggaggaggagagctgctctgattgttagaattttcagtttttctgctctgttttttccccacctttgtggtttttatctacctttggtctttgatgatggtgacctacagatggggttttggtgtggatgtcttttctgtttgttagttttccttgtaacagtcaagacccttagctgcaggtatgttggagtttgctggaggtccactccagaccctgtttgcctgggtatcagcagcggaggctgcagatcaggggatattggtggacaccaaatgtcgctgcctgatcgttcctctggaaattttgtctcagaggagcacccggccgtgtgaggtgtcagtctgcccctcctggggggtgcctcccagttaggctactcaggggtcagggacccacttgaggaggcagtcttttcgttctcagatcttcagctgtgtgctgggagaaccactagtctcttcaaagttgtcagacagggacatttaagtctgcaggggtttctgctgccttttgtttggctatgccctgcccccagaggtggagtctacagaggcaggcaggtgtccttgagctgcggtgggctccacccagttcgagcttcccagcctctttgtttacctactcaagcctaggcaatggtgggcgcccctcccacagcctcattgctgccttgcagtttgatctcagactgctgtgctagcaataagcgaagctccatgggtgtaggaccctctgagccaggtgtgggatacaatcttctggtgtgccatttgctaagacctttggaaaagcgcagtattagggtcggagtgacccgattttccaggtgccgtctgtcacccctttccttggctaggaaggggaattctgtgaccccttccgcttcctgggtgaggcgatgcctcgccctgcttcggctcacgcttggtgcgctgcacacactgtcctgcacccactctctgacaatccccagtgagacgaacctggtacctcagttggaaatgcagaaatcatttgtcttctgcattgctcacgctgggagctgtagactggagctgttcctattcagccatcttggctccaccccctagaaactatttttcatctatcagattggtaacagtttttaggtgtagcaatatcaaatgttgacaagggtgcaagcaaagtactctcatacatagctggtaagagtggaatagcccctttggatgacaatttggcagtatctataaaaaaagaaaatgtatatcctcatgactctgtaattcccacttctttctaccctagtaaaaccttgcacatgtgcacagaaatcatgtagcagaatatttcattatggaaaaaaaatgaggcagatctgtatatgctgatataaataaatctccatgactaattaagttaaaaatggcaagttacagaataacatatatatatataaaattctatgtttaacacattttatttggtataaacacacacgtgtgtgtgtgtatatactatatacttacatcaattatatattctagtaatggatattatgtgatatgtaatatataatacatttgtttaatatataatcatgcaccaaataatgacatttcagtcagtgacagaccatggatacaatgatagtcccataagattgtaatactgtatttttactgtaccattatgtttagatacaaaataccattatgttataattgcccacagtattcagtacagtcatatgatgtacagtcacatgatatacagttttatagcctaggagcaataggctataccatatagcctgggtgtatagtaggctatactatatagatttgtataagtgcacactatcatgttcacacaatgatgaaattgcttaacaatgcgtttctcagaatgtattcctgttattaagtgacatatgactgtaaatgtctagatatgtaatatttgactatgtaaatgtctgcaaaaaatggaaggtatgcatcaagctgataacagtgcttacttctggagggggactggaattttggcagggttgaggcagtcaaggagacttgacctttacaagtattatctatttttttatataaatatatttatatgttacttctataagtaaaaatatagaatatatttttctataagtatagataaatatagaatatatgtaatatagaatatatgatatactatatatagaatatatgtaatatagaatatatcatatatattctgtatgtatagaatatagaataaatgtagaatatatcaaataaagaatatatgaatatacacatacatacatacacacccatgttattagtggttttaaatatgcagggtagtttgggcgtggtggctcatgcctataatcccaatactttgggaggccaagggaggtggatcacttaagctcaggagttcgagaccagcctggccaacatggtgaaaccctgtctctactaaaaatacaaaaattagccaagtgtggtggcaggtgcctgtaatctcagctacttgggagactggggcacaagaatcttttgaacctgggagacagaggttgcagtaagccgagatcacaccactgcactccagcctatgtgacagagcaagactctgtctcaaaaaaaaaaaaaaaaaagcaaggtaactataaagattgattttcattggttatactgaagtgactgagtacattgcttggaaaacagctctaggctatttagaaagcttctctgatatagccccacctaatctgcctctgcttattcgtgtcagtctaatactggtctagggcgtgcatataatcttcttggctgccaactactcatccagtcagttttcgccaatcttttttggttatgagaataggatggaatttgggttttccactgtcaaacttcagtttctagacttcgttttctttttttttttttccatttaaccctgagtggacacagcacatgtttcagagagcacagggttgggggtaaggtcacagatcaacaggataagaatttttcttagtacagaacaaaatgaaaagtctcccatgtctacctctttctacacagacacggcaaccatccgatttctcaatcttttccccacctttccccccgctctattccacaaaaccgccattgtcatcatggcccgttctcagtgagctgttgggtatacctcccagacggggtggtggccgggcagaagggctcctcacttcccagtaggggcggccgggcagaggcgccccttacctcccggacggggcagctggccgggcggggggctgacccccccacctccctcccggatggggcggctggccaggtggggggctgacccccctacctccctcccggacgggacggctggccgggcggggcctgacccccccacctccctcccggacggggcggctgctgggcggagacgctcctcacttcccagacggggtggctgccaggtggaggggctcctcacttctcagatggggcggctgccgggcggaggggctcctcacttctcagatggggcggctgccgggtggaggggctcctcacttctcagacggggcggttgccaggcggagggtctcctcacttctcagacggggtggccgggcagagacgctcctcacctcccagacggggtcacggccgggtagaggcgctcctcacatcccagatggggcggcagggcagaggcgctccccacatctcagacgatgggcggccaggcagagacgctcctcacttcctagatgggatggcggccgggaagaggcgctcctcacttcctagatgggatggcggccggcagagacgctcctcactttccagactgggcagccaggcagaggggctcctcacgtcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatcccggcacctcgggaggccgaggctggcggatcactcacggttaggagctggaggccagcccagccaacacagcgaaaccccgtctccaccaaaaaaatacgaaaaccagtcaggcgtggtggcgcgcgcctgcaatcgcaggcactaggcaggctgaggcaggagaatcaggcagggaggttgcagtgagccaagatggcagcagtacagtccagcttcggctcggcatcagagggagaccgtggaaagagagggagagggagaccgtggggagagggagacagagggagagggagagggagagggaaagggctagacttcgttttccaaatgcatgcagaactgcagttgttattgagtagataagtttgaaagttctgaatataagaatatttgtgcagctctttacagtttacaaaatgtctacctttttatcttatttgatcttcccaacaaccctgtgaggtaggtgttattattaattattgacatagatagggaaacctttgggagtccccaagagctcccctagatcaaatgattcactaggaggactcacaggactcagcatatagtcatactcacagttaagatttatggggctgggtgccatggctcacgcctataatcctagcactttaaggaggccaaggtgggaggatcgcttgagcccaggagtttaagaccagcctgggcaacatggcgaaaccccatcactacaaaaaaatacaaaaattagccaagttggtggcagactcctgtagtccttgctactcaggaggctaaggtgggaggatcacttgagcccgggagataaaggctgcagtgaaccatgatcatgcctctgtactccagcctaggtaagagtgagactctgtctcaaaagaaagaaagagacagacagagaaggagggggagaacggggagggagggaaaggaaaggaagaaggaagaagggaaggagggagggagggaaaagaaaagaaaaaaagaaagaaaataagcaaatgaagagccagatgtggtggcacacacctgtaatcctagcactttgggaggcagaggcaggaggatcacttgagcccaggagttcaagaccaacctgggcaacatatatatatacatgtgtgtgtatgtatatatatatatatatatatatatatatatacgtatatatatacatatatacgtgtatatatatacgtatatatatacatatatacgtgtatatatatacgtatatatatacatatatacgtgtatatatatacgtatatatatacatatatacgtgtatatatatacgtatatatatacacatatacgtgtatatatatacgtatatatatacatatatacgtgtatatatatatatacgtatatatacacatatatatacatatatacacatatacgtatatatatatacacacacatgtacacacacacacacacacatacacacacacacacacacacaaactcttttctgaacagaaaccaaaactaaaagatgaagtgactttccttaaagatacttatatagtaagcgtggcagtcaagattaaaacccagaccctcagattccaaacatttcctactacataattttaatctccatcaaatcaagagtaaatgttttcagcgtgcagttgaagtggtaaaaattaatgcatagttccttgagacatggaatgctgaagtgatttttcttcctgtgccatataatgtcttctttctctttgacctataacctttctaggataacataaaagagctagaattagaagtcatcaatctgcaaaaggaaaaggaagaattggttcttgaacttcagacagcaaagaaggatgccaaccaagccaagtaagaataaagttaataaatgttatttcaagtccctactatgtgtgaggagctttgcaagaaatagagaagtagaagtcccatttactgcccctaaagatttaaacctaattatgaagaggaaacctaaacacaaaaaatggttaaataattgcaattttaaatagcgtctcaagttgacagtaaaagaatgtcataacacagcacatgattagtagccaaataaatttcttaggcagtaattgtgttaagagttcagaggcgaggaatatcaattcaggctaccatgatcaaggaaggctttgtaaaaagttagcatttgagctggcttttgaaagattatcacacttactagataacagcagtttctttgtccctgcactaatggtaaattagcttgtgaatggaattaatgtccaggctagtgatttaaaaaatcaatctagccatctcttaccagttaagaataaaaccaaagcagataaccataacatcctactctccttcagacctctgccgtatgggctatcctaccttctttttactcagtgactccgttttatctctcagttgagtctaaagctcatgtttgtaaaagttatgctgaatgtttactttctatctcagacttgtataataatcatcagaattattcttcatagctaaagtgaagtgaaatgccttcaaagaaccattttgatgcaaaaggggcggcgtatattgaggcagttgcattgctgtgtactaaaagttgtcttactctttgtattaagctcctattattgagacaggtttggttgtttgggtggtattctttttttaagatggctatgtgactagtcacctattttatatatgtcagtgttgtaactctgggagtctagtattatgtcttttgaagtcaggctttgctgctggtagtcctcacttctacagcatctgtgtttaggttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacgggtaataaattctcatccttgcatttacccccattggaatttacaaacataggtattccatttagaaatatactagaggtgttttcaggtgagaaaatagcaggcagagcaatcatttcaagtgtgtgaatctccacaaatgtcccttttgcagaacattgtgctagtggtcatctaggatctgcttaataaaacgttgctttgacattcaaaatttaatgttagagtctctgaaaccaaagaacaaagacatctccatacttagtgggttatatcctgatcaccttccatgatcatgcagcataattttgtaaagtagtaataagatgacagacacctagagaaaattctcagttattgaatgttcaacttgtggcaccaacaaagtggtggttacaggctacttgtactgaaacctttagaatacaatggttactaggtggatttgtcctggaggcttagtagatgtttccttgaaatttcatttgtatacagtgaatttagggctggatttagcttgtaggtacatttttatttaatttcttctcagtgttcacttgtatagcctgtacttggaaaccctgtgcaagcatagcaaggggtattgtaagcctaatcagggaatctgttggggactgctttcccagcctagttctggcttttctctcttcttaatggtaagtctatccatccgcaccagcctagaataaactgcagatgactaatacttttgctggtttttgtttttatagatgatgaaaaaccagcgggtacagttaatgcgtcaaatgaaagaagatgctgagaagtttagacagtggaagcagaaaaaagacaaagaagtaatacagttaaaagaacgagtaagtaactaaaacttcttgaaggcctaggtaataaacccttctctgagctgactaacaattttaatgcttctcttcaaacacctcgtgtctccaaaagtgtgacattctcatgaatttaacaactttattaaatgtctactatgtctattatgtgcaaggtactatctactaggcactattagaaatagaaaaattagtagtatataagctctgcccttgaagaatgtcttacctaaaggagatggtaagatataagcatggatttctcaaatacaaggaagaaagagatttgggctataagaataaaataaaaagtaactaagagaaaagaaagcaaatttgcagttggagtgaaaagatgatggttgaataggccctgaataataggaagggttatgatagagataagtacaagcattccagatagatagatcaaagaaatagagatgacaactttgtagacacattcaaggaatggcaagtggtccaactggggtgaagtatagtagtggaccattccattggaaaggcaagtcgaagctggattattaaagatccaagaagtttgaactcattttgttagtagcataaagatttttaagggtttttagaaagtgatatcaacaaaatactgctttagaaagatatatctgggaataatgtatagagcaaactgtaatattgagaaacagaggccagaacacaagaagatattgtataatccagaagaattataagggcctgaatatacatctgacaacagagcccccagaatatatgaagcaaacactgacagaaatggagagagaaatagacaaatcaacagtaataaatatttggagacttcaatccacctctttattttctttcttttttagatatggggtcttgttctgttgcccaggctggagtacagtggtgcaatcatagctcactgtagcctcaaactgctggtctcaagcaatcctcccacctcagcctcctgagtagctagaactacagctgtacaccatcacacctggcaaattttttattttttgtagagatggaatctcactatgttgcccagactggtctcgaactcctgggctcaagcagtcctctcacctcggcctgctaaagtgctggtattacaggcatgagccactgaacccagcccctactttaataatggatagaacaataggcacaagatcagcaaggatattgaagacttcaacaatataatacctagcattttcatatctacattcataagagatattggtctataagtttatgtaatatgctagattacacactatacctaacagaatctatagactacgccaaccaacaacagcaggatatacagtcttcctaggtgcacatgaaacattctccaggatagaccatatgctagaccttttatgcctcaataaatttaaaagtattgaaacaggccatgcatggtggctcactcctgtaatcccaacactttgggaggccaaggtgggcagatcacctgatgtcaggagttcaagaccagtctggccaacatgatgaaacaccgtgtctattaaaaatacaaaaattagccgggcatggtggcacatctgtgatctccagtattcaggaggctgaggcaggagaattgcttgaacttgggagatggaggttgcagtgagctgagatcgtgccactgcactccagcctgtgcaacagagcaagactccgtctcaaagaaaaagtattgaaaataatacaaaatctgttctctaaccacaatggaatgaaattaaaaatcagtaacaaaaataaatttaggaaattcacaaatatgaagaaattaacataatcctaaataaataatgggtctaaaaggaagtcatagggaaattaaaaaatactttgagattaataaaaacaaagatacaacataccaaaacttatgagatacagctaaaacagtgtttggagggaattttatagttgtaaatgcctatattaaaaaatgcagaaaggctcctgtagccccagctacttgggaggctgaggtggaaggatcacttgaccccaggagttcaagaccagcctgggcaaaattgtgagactgcatctcagttttttttaattgaagaaagatcttaaaccaataacctagccttctactttaaaacactgaaaaaaagagagcaaactaaacccaaagctagtagatgaaaggaaacattaaaagattagagtagaaataggctgggcgcggtggctcaagcctgaaatcccagcattttgggaggccaaggtgagcagatcacctgaggtcgggagttcgagaccagcctgagtaacatggagaaaccctctctctaccaaaaatacaaaattagctgggcatggtggtgcatgcctgtagtcccagctacttgggaggctgaggcaggagaatcgcttgaacccgggaggtggaggttgcagtgagccgagatcgcaccattgcactccagcctgggcaacaaaagcgaaactgtctcaaaaaaaaaaaaggattaaagtagaaattaatgaaatatgaaatagaaaaaaacggggaaaatcattgaaaccaaaagttggttttttgaaatgatcaacaaatactgacaaaccttcagatagccttaataagaaaaaaaaagaggccaggcgcggtggctcacacctgtagtaatcccagcactttgggaggctgaggcaggcagatcacaaggtcaggagatcgagaccatcctggctaacacggtgaaaccccatctctactaaaaatacaaacaaaaaaaaattagccaggtgtagtggtgggtgcctgtagtcccagctactcaggagtttgagggaggagaatggtgtgaacccggaaggcggagcttgcagtgagcagagatcgcaccactgcactccagcctgggcaacagagcgagactccatctcaaaaaaaaaagaaaagaaaaaagaaaaaaaagaaagaaaatttaaattactaaagttaggaatgaaagagggaatatcactactagtcttgccggaaggaaaggattataaggaattactattaacaactgtatgccaacaaattagatagcctagattaagtagacaaatgcctggaaagacaaaaactaccaaaactgactcaagaagaaatagaaaatctgtatagacccatgacaagaagttaaattagtagtttaaaaacttcccacaaagaaaattccaggcacagatggcttcactggtgagttctatcaaacattttaagaaaaaatacccatttcttggccaggtgctgtggctcatgcctgtaatcccagcacttttggaggccgaggcaggcagatcacctgaggtcaggaattcgagaccagcctggccaacatggtgaaaccctgtctctactaaaagtacaaaaattatttgggtgtggtgacacacacttgtaatcccagctacttgggaggctgagacacaagaattgcttgaacccaggtggcgaaggttgcagtgagccaagatcacaccgctgcactccagcctgggcgatagagtgagattctgtctcagaaaaaaaaaaaaaaaagacagaaatacccatttctcagaaactcttctgaaaactagaagcagtggaaacacttcccaactcattccatgaggtttgtgttccctgataccaaaaccaaagacatcacaagaaaagaatactacagaccaatatatcttaatataggcatgaaaatcctcaacaaaattctagcaaactaaatccatcaacatttaaaaaggatgataggctgggcgtggtgactcacacctgtaatctcagcactttggaaagccgagatgggcagatcacttgaggtcagaagttttgagaccagcctggccaacatggcgaaaccctgtctctactgaaaatacaaaaaaaaattagctgagcatggtggcatgtgcctgtaatcccagctacttgggaggctgaggcacgagaattgcttgaacccaagaggaagaggctgcagtgagccaagaccgtgccactgcactccagcctgggcaacagagtgagacactgtctcaaaaaaaaaaaggatgatacacttatgaccaagtgaagtccatctgaaaaatgcaaagtttgtttaatatatggaaatcaatttatgttatatactgtatcagtaggaaaaaggacaagaaccacatgatcatctcaatagacacagaaaaagcatttgacaaaaatctaacactcatgataaaaacactcaagaaactaggaatagaagagaacttcctcagcgtaataaagggcgtgtatgaaaaacccacagctaacatcatacttaatggtgaaaaagagcatacttttcccctaagatcaagaacaagacaaggatgtccactcttgccatatctattcaacattgtcctggaggttctaaccaggaagtttagggaagaaaaatatataaatggcatctaaactggaaaaggtgaagcaagactatctctgtttatagatgacatgatcttgtatatagaaaatcctagagaatccactaaaagtctattagaattaatatatgagttcaccaaggttgcagaatataagatcaatataagaaaataagttgtgatctggcacagtggctcaagcctgtaatcctagcactttgggaggccaaggcaggcatatcacttgaggccaggagttcgagaccagcctggccaacacggtgaaaccccgtctctactaaaaatacaaacattagccaggcatggtagcacatgcctgtagtcccaactacttgagaggctgaggcacgagaatcatttgaacccaggaggcagaggtttcagtgagctgagatcaggccactgcacttcagcctgggctacagagcaagactctgtctcaaaaacaaacaaacaaaaaaaacaaaaggaaaagaaaagaaaatcagtagtatatttatatactagcaattaacaatttgacaatgagattaataaaacaatcccacggctgggtgtggtggctcacgcctgtaatcccagcactttgggaggctgaggtgggcagatcacaaggtaaggagctcgagaccagcctggccaacatagtgaaactccgtctctactaaaaatacaaaaaattagctgggtgtggtgacaggcacctgtaatcgcagctacttaggaggctgaggcaggagaatcacttgaacccgggaggtggaggttgcagtgagtcaagatcatgccactgcaccactccagcccaggcaacagtgcaagactctgtctcaagagaaaaaaagaaagaaaacaattccattaataataggatcaatacaaataaaatacttaggaataaatttagcaaaagaagtgtaagacttgtatacttgaaaactactgaacatcattgaatttaattaaggaagacttaaataaatggaaggatatcccatgttcatgggcaggaagacttgatattctaaagatggaatacccttcagattgccttacagatgcaacacaatcccagtgaaattccatctggtttcttcacagaaactcacaaactgattctaaaatatatatggaaatgcaagggacctagaatattcaaagcaatcaaggagaagaacaaatttgtaaatgtcacatttactgatttaaaaactttctacaaagctacactaatcaagactgtgtggtactgtgtaaagatagacatataggtcaatggaataagattgagaatccagaaataaacttacacacttatggccagttgattttcaacagtaatgccaagacaattcaatgaggaaaacaattttgtcttttcaacaaatagtcctagaacaaccgggtagtcatatgcaaaataatgaagttgaaacttgtggccaggcacagtggctcacgcctgtagtcccagcactgtgggatgccgaggcgggtggatcacttgaggtcaggagttcaagaccacctggccaacatggtgaaaccccgtctctactaaaattacaaaaaaattagctgggcatggtcgtacatgcctgtaatcccagctactctggaagctgaggcaggagaatcacttgaacctgggaggcagaggttgcagtgagctgagatcacgcccctgcactccagcctgggcaacagagtgagactctgtctcaaaaagaaacttgctctcataccatatacaaaaattaaagcagatcaaaaacctaaacgtacgagctaaaactataaatctcttagaagaaaacataggtgttaatctttgtgactttggattagacaatgatttcttagatgtgacacctaaagtacaaacagctaaccaaaaaagagttaaattagacaaaattaaaagcttttgcattgtaaacaataccatcaagaaagtgaatatgatcaggcatggtggctcatgcctgtaatctcaacactttgggaggccaaggtgggaggattgcttgagcccaggaaattgaccccaccctgggcaacatagcaagaccccatctctaacaaaaaaaaaaaaaaagaaagttaatagccagtccatagattgggaggaaaatatttgcaaatcatatagctgataagagtcttatatccaagatagataaagaactcttactgtctgggcacggtggctcacacctgtaatcccagcactttgggaggccaaggcgggcggatcacctgaggtcgggagttcgagaccagcctgaccaacacggagaaaccccgtctccactaaaaatgcaaaaaaagtggccgggtgtggtggcacatgcctgtaataccagctactggggaggctgaggtagaagaatcgcttgaatccgggaggtggaggttgtggtgagccgagatcgtgccattgcactccagcctgggcaatagagtgagactccatctcaaaaaaaaaaaaaaaagaactcttaccaatcaacaataaaaatataacccagttttaaaatgggcaaagcaataagtacatgaaaaggtgctcaatgtcatttgccatcagagaaatacaaatcaaaaccacaatgagatgcaatttcacatctactaggatggctataaacaaaaagacagataataataagtcttagcaagaatgtggagacactgaaagcctcatacattttcagtaggatgggaaaatggtatagctgctttggcaaacagtttagcagtttatcaaaaggctaaataaaaacgtagaggtaccatatgatccagcaattccactcttagttttgtctacccaggagatacgaaaacatgtcatatatgcaaaaccttgtacccagatgttcatgcagcagtagtcataatagccaaaaagtggaaaaacccaacatgtccatcaactgatgaatgggtaaataaaatgtggtctatccatacagtggagtattattcagccatacaaaggaatgaagtactgatacatgctacaacatggatgaggcttgaaagcattttgcttagtgaaagaagccaatcacaaaagaccatgtatgataggattccatttatatgaaatatccagagtaggacattaaaatctgtagagacaaaaagtagattagtggttctctagggctttggggtggggtgatggggttgtagggtgatcactaaacagtatatttctttttgtggtaatgaaaatgttctaaaattaagtgtggtgatgtttacatcaactgtgtgaatgtgccaaaagccattgaatcatgtactttaaatgagtgaattgtatggtatgtgaattatatctcaataaaactgttaagaaaaacaaaagaagaaaggagacatctctataaagtgatgacaactttacattctacaggaatatatattccacattgacaaggatctttgttttgctcacttctgcatttccaatggctagaacagtggctggcaagtagtgggcactcaataatgtttagtgaatgattttaatcataattaatgcaaaatatacctttcaaaaaatgaaggaagtagggcaacaaaaagtaccgcgggcttttcagtgactgtaaagtcagaggaaacagctagtttgaagagacaaagttggttttaggagaataatctttgggatggagagacctagaaaatattggataatgttggcctagagttcaagggagaagttgggctggactttgcaattaagagttgtctttgtgaggccaaggtgggtggatcacgaggtcaggagttcgagaccagcctgaccaacatgctgaaaccccatctctactaaaaatacaaaaaaaattagccaggcacggtggcacatgcctgtaatcccagctactcaggaggctgaggcaggagaatcgcttgaacccgggaggtggaggttgcagtgagcagagatcgagccactgcactacagcctgggcgacagagggagactccgtctcaaaaaaagatttgtctgcatagaggtgaaaaatgaaactttgggagtaatgagataatggagacagagaatatatagaaaaagaaggctaagaagagaatctctttttttttttttttggtctcaccctgtcatccaggctggagtacaatggcaccatcttggctcactgcaacatctgcctcctgggttcaagcctcctgagtagctgggactacaggcgcatgccaccatgcctggcaatttttttttgtatttttagtagagacagagtttcgccatgttggccaggctggtcttgaactcctgacctcagatgatccacccaccccagcctctcaaaatgctgggattacaggcatgagctaccatgcccaactgagaatctatttcatgtataagaaaatgaaaagaagacaatgaaatttgtaaggtagaaaaataattaggatggtatggggaagttattggtagtgctaacgatgctgggagagaagccaaagaagatagtgactgtaaaaacaccactgaatttaagaagtaggaaattccaggacaactggtaggaactacttacaaggggattatggagtgaccagtaatgacaattggaagcactaaacatagacctctctttcaaaaagtctggtactaagaagactgttgacttttctctttccactggactagcttagtcctctgactgtgtttctttaattatcttgacttttcatttcaacacacatcatattttattataattgtattgcatgttgtttgtattctctggtaatctctgtaggagtagtaaccatgtcatgtttatctctgtatcctagacacctagcccagtgcctagtgtttagttgatggcacagtaaatattatattgttgaatgaaatgaattgttctagtatgctggcaaagacatgacaaaaatggctgaccattctatccagattggattggaacaagtgaagccagaaggagcttaatggattattagaagagggaaatggccaagaaatcaaagcagttaaatattgtgtgctcagctgaagcaggtgataccccatagtatttcttggtattctttatctttaatctctgggaagaaagagcacattcagtaataacctgtttttatttttattttagattcagtgggtgcaggagcaggtttgttacaagggtatattgtatgatgctgagctttgggcttctactgatcccatcacccagatagtgaacatagtacccaataggaagtttttcagctcttgcccccctttctccatccctccctccttttagagcccccaatgtctattgtttccatctttatgtccgtgtgtacccaggttaaccttgtttttttcaaaaatgagaaacctcttttttttttagctgcaggttactttaattttataggtggttggctatgtgatagactttctcttttttgccagccacctgggttttgtaatggatggacaggtagggttgatgggaaaagaatactggtctatttttcaggagacctgaatcccacctctgtcaataactacctatgtggaaaggactgttcattagatgatctttaagcttccttccaggcctcacattctaggatattatttctagtagttgatttatgactgagactcaagaatttggccacagagcaataagccaaagggaaaaaccacttcccctctacacacaaacatggtttctagaactacgagtttttgactcatatgagaagatgaaggcagctcactgtattgtagttaaccttacaaatcaaggatgtcttgagagacaccttatagtataaggttttattttagctagctgaacagcaattaatatctgacttttttcttgtcaggaccgtaagaggcaatatgagctgctgaaacttgaaagaaacttccagaaacaatccaatgtgctcagacgtaaaacggaggaggtaagaaaattcaatctgctaggtcaagtgtattgtcatcttcaggtttaaatgcttgcaaagtaatatcctttaaactagcaagcgtcctgagaaaccagggatgccaatcttcacaagcaattcctaaatcttgatcactgtttatatgccactgtgagcagataaaaacttgatgaaaaatggtactgttcaaataaggattttttcctaactggacgtgagcctttcctgaaaaaacaaagtgatattgatatgtgacatttctagacacttttagtctgcagaacttccttgaagtgtgttcctcccctaggcaccaaagcagtagctgttcaccagtgttatgtccatggaagtttataaacctggttcctataggaactcaaacccatagaatttttatctttactaatgtgctagaaattggattttttttttttaccattcattcaacattactatgtgccaattttatttaggcagcagctgccaacaagcgtctcaaggatgctctccagaaacaacgggaggttgcagataagcggaaagagactcagagccgtggaatggaaggcactgcagctcgagtgaaggtatgaacaacttgaactgccatttctcttgtggacactgggaacaggaaaaaaggagaaatagctttttttttttcctttttttagaagtaaacactgcaaaatctaaagttctacttgaaagccttatttcctaaagatagcaatgtctttgaactgttgttaaagaccaggagtatagaactctttctatctttgcccctattgaggttcagttacttttttaaacagcttcattgaagtagaattgacatattataaattgtacatatttaaagttcacaatttggccgggcatggtggctcacacctataatcccagcacattgggaggccgaggtgggcagatcacctgcggtcaggagtttgagaccagcctgaccaacatggtgaaacctcatctctactaaaaatacaaaaattagctggttgtggtgacaggtgcctgtaatcccagctacttgggaggctgagggaggagaatcgtttgaacctgggaggtggacgttgcagtaagccaagatcgcaccattgcactccaaactgggtgacagtgaaactctgtctcaaaaagaaaaaaaagtatacaatttgatgagtttggacacgtgtatacacccatgaaatcatcaccataatcaagataatgacagtgtgcttcattgcctaaactttctttgtatccctctgtaatcccttcttcttatccctctgtaatcccttcttctcctccctggtctacccgtctactccccatttcatatatatttctttatatccccacagtggttccaggcaaccattaatctgctttctgtcactatggatttgttttcatctggaatcatacattatgtattttttttctggcttttattcacaattattttgagattcatccatgtggttgcatatgtcatatacaacttctttcctttttattgctgagtggcatcccattcattgtatggctataccataatttgtttttatatccatctgttgatggatacttgagtggtttccagtttttggctcttacaaatattgcactgaacatttgtgcacaagcctgtgtggattttttttaatttcttttgagtagatagctaggagtaaaatggctttcttgtatggttggtgtatgttttaactgctaagtggctgccaaactgttttccaaagcagttgtaccattttacattcctactagcaatgtataagggttctagttgctacacattcttgccaataattagtatggtcagtcttttgaattttagctattctgtgtgggtgggtagtggaacctcattgtggttctaattttcttttctgtaatgactaatgatgttggacatcctttcatgtgcttatttgccatatgtatgttttcttttgtgaaatatgtgttcaaatctgtccccatttttaaattgggttgtttatctttttcttattattgaattaaaattctttatatattctagatatatttaacagaggacttctgtgttttacaaatattttctccctggctgtggcttgcccttttcaatttgtaacagtgtcttttgaagagcaaacatttattatgttaatgccatccaatttattgatatttttttctttatacttaaacagttttcatatcttgcttaagaaatcttggctgggtgtagtggctcatgcctataatcccagcactttgggaggctgaggcaggaggattgcttgaggccaggagttcaagaccagcctggggagcaaagtaagatcctgtctctacaaaacaaaattttaaaaaaattaaccagacatggtggtgcatgcctgtagtcccaactaccggggagactgaggtgggaagatcgcttgagactgggaggtcaaggctacagcaagccatgatcgcaccactgcactccagcctgggtgacacagcaagatcctgtctcaaaaaaatttaaaacagaaatatttgtctggccaggctcagtggctcatgcctgtaatcccagcactttgggaggccaaggcgggtggattacctgaggtcaggagttcaagaccatcctggccaacatggcaaaaccccgtctctactaaaaatacaaaaaattagttgtgcacggtggtgtgcgcctgtagtcccagctactcgggaggctgaagtggaagaatcgcttgaaccggggaggcagaggttgcagtgagccgagatcgttccactgcactccacctgggtgatagagcgaggcttcgtctcaaaaaaatatatatatttgtcaaacccatggtcgctaagatttccccctaagttttcttctagaagttacatatttttaagctttacatttacgtctttgattcattttgactggacacctttgtcaaaattaaatatccatacatctatttcagattgtttcattgatctatatgtctatttttatgccaataccaaaaagtcttgaatgcagttgctttttaagaaatcctgaaatcagtgtaagtccaaagttgttgttctttgtcaaaattgttttgggaaaactgggtcctttgcatttccatatacattttagaattatcttgttaatttctacaaaacagcttgctgggagttggattaagattgcatagaatttacaaatcaattcaaggagaatcaacatgttaagaatatttagatacacgaatgcagtatatctctttatttaggtttttaatttctctcagcaacattttagtttttagtgtacaagcgttgtacatcttttgtcaaacatatccctgagtatttcatatttttatgatattgaaaatggcatttttatttccatttccaattgtttagatattcttgttggttctcaaagcttttttgtagagttcttaagattttctacctagaaaatcatgtcatctgcaaatatggacaattttatttcttcttttctgttctgtgcttttttatttttttaacctttgtcttgccttattgcacttgctagaacctccagtacaatattgaatagactaggtgagaggctacaaccttgctttgttcccagtcttgggcagaaagcattcagtttttcaccgtaaagtatgataatagctatagattttttggtatatgtcttttatcaggttgaagaagttcctttttttagcttgcgaagtttttattacaaattgatgttgggttttttcaggagcttttttttctgtttctgttgagatgatctgactgttggttgattggtcagtttttattctgttatatggcaaatggcactgatttttccctaatttattctgtcaaggcatagctgacatacaataaaataaacccttttgttgtatagttctatgtgttttgacaacatgtacagttgtgtgaccactacaacaatcaagatacagaatagttctcttatccccagaaactcccctatatctcttacagccaattcctcccacaaccctggcccttgacaaacactgatctgtactctgtcattattgttttccctttccatcagtgtcatagaaatagaaacatacagtatgacttccttcacttagcataattcgagattaatttgtgttgtttgtgtatctgtagtttgcgtgtttttgttgttgttgttgagtagtatttcattgtatggatataccacagtttgtttatccattcacctgttgaaggatatcttaggtttttcttttccttaggttttggcaattacgaataaagctgctgttaaaaacacatacacgtttctatgtaaactaattatttcacttgggtaaatacctaagagtgggactactgggtcatatgataagtatatgcttaatttgtaagaaactgccaaattgtttatccagttagttgtttattgctgatatatagaaatacaatttatttttgtatattaacttttatctcatgcctttattattctactagctcttttataggtttttaggattttctatgtagactatcatgctgtctgtaaatacaattttatttcttcctttctaatctgtatgtctatcatttctcctacttgccctattgcattggtgagaaccttcaggatgatgatgaataggagtggtgagaatagacatccttctgttcttcctgatcttagggggaaagcattcagtctttcaccattaagtatattaactgtagttaatttttttgaaatactttttgtctctagttagttgatttggtgaattattttgattgatgttcaaatatggaaccaaccttgcatttcttttttttttctttccgacttttactaggttcaaggattacatgtgcaggtttgtttttacatgggtaaatggcatgtttcaggggtttcgtatacagataattttgtcacacagataatcagcatgatacccaataggtagtttctcagtcctcaccctcctcccaccctccaccctcaagtaggccctggtgcctattgttcccttctttctgtccatgtgtactcaatgtttagctcccacttagaagtgagaacgtgtggtatttgattttctgttcctgcattaattctcttaggataatagcctccagttgcattcatgttactacaaaggatgtgattttgttcttttttttatggctgtgtaatattccattccaaccttgcatttcttggataaactccatttaattgtgatatatcatcctttttatgtattattaaattcagtaatacataaaaaaacttgtttaaatttttgtatctgtgttcatgagggatattggtgtgtagttttttgtaataccttggtctggttttgatatcaaggtaatactggcctcagaaagagctgggaagtgtagtcgtttctcttcaaatgtctggaagattttgtgcagaattaatattgtttctttcttaaaaatttgatagaattcatcaggaaagccatctgtggctggagagatttatgtttcttgcttagttttgctttttggggagagggatgttaaataaagttttaaaaatagatataggattgttcaaagttatatgtttctccttgagtaagctttggtagtttgtgtgtttcagagaacttgtctgtttcatctaagttgtcaaatgtattggcataaagttgttcatcatattcccttatcgttctaatatctgtaaaatctcagccaggtgcgattgtttatgcctgtaatattggcacttagagaagctgagatgggaggatcacttgagcccaggaattcgagaccagcctgggcaacatagcaagaacacatctctattttttttttaaatctgtaatgatgtcatctatctcattcctgtttgtatgttttctcctttttctcaatcagtccaactagaggtttatcaaagaaccaactcattcttataataggtaaaatggtaatttttatgttatatatattttaccacaataaaaaaattcaaaacaactcccaattcattaatttccactctgatcttataataataataataataataattattattattattattttgagacggagtctcgctctgtcacccaggctggagtgcagtggcgtgatcttggctcactgcaagctccgcctcctggatcttttttttttttacttctgcatactttggatttattttggtcttctttttttacttaaggaagaagctaaggtcattgatttctttcttttctaatataggcattcagtgctataagtttccccttaagtattcctttaacaacatcccacaaattttcataatgttatattttcactttcattcaattcaaaatacattctaattttcttattgatttttttctttgacccatgggttatttagaagtgttatgtagtttccaaatgtttggggatttttccaaatgtctttttgttattgatttccaatttaattctaatatggtcagagaacatacttcatatgacttgaatccttttgaacttattgagacttattttatggcccagagtatgatcaatcttagtaaatgttctatgtgtacttgagaagaatgggtattctgctgttgttggatggagtatctataaatgtcaatcatgtcaatttgattgattgtgctgttaacatctattgtgtccttgctgattttctgcatactcgtcctatcaattattgagaaataggtattgaaatcaccaactataattatggattttttccttagagttctacatttaggattaattgatccctgtattattatgaaatggacttctttattcttggtaatattctttgttctttgttctaatatctactttgtatgatattactgtagcccctccaactttctttttattaatgttagtatgttgtttttttttttgtcatggtgtatttaatgttaacgtatttgtgccttcatttttaaggtgtgtttcttttcttttcttttctctttctttctttctttctttctttctttctttctttctttctttctttctttctttctttctttctttcttttttttttttttttgacaagatcttgctctgttgcccaggctgaagtgcagtagcacagtcacagctcactgtagccttaacctcttgggctcaaatgattctactacttcatcctcccaagtagctcagattacaggcacatgccactacgcctggctaatttttgtattttttgtagagatggggtttcaacatgttgctcaggctggtctcaaactcctggggtcaagtgatccacctgcctcagcctcccaaagtgttgggattacaggtgtgagctaccacacccagccaaggtgtggttcttataggcagcatatatttgggtctagctttttttttttttccatagacaggatctcactctgttacccaggctggagtgcagtggcgtgaccatagttcactgtaacctcggatacctggactcaagtgattctcccatctcagtctcccgactagctgagactacattcatataccaccatacctggctaatttttctactttttgtagagacagggtctcactatgttgctcaggctggtcttgaactatgggcctgaagtgatcctcccaaagtgctgggactacaggtgtgagccactgtgcccagccatgtctagcttttttaatccaatctgaaaatctctacaacttaattggggtgtttagaccatttacatttaatgtgattattgatacaggtaggtttgagctatcatcttgctatttgttttctattgtgtcatctgttcttcattttctttttccctgctttttccttttttggatcagttgaacatttttatgatttatattatctttgtttacttgtacatgattttgtttcatgtattttggtgctttgttattagggacgtacacattaaggattatattctattgaacaatcggctcctttatcatgaatcctttttatccctagttttattttttgataggaattctactccatctgattctaatataatcactctggctttcttttgattactattagcatggtataccttcattaaaagcagaaatattctcagggatagttactgtttcaaaaagtgaattttggctgggcatggtggctcacacctgtaatcccagcactttgggaggccaaggtgggtggatcacttgaggccagcagttcaagaccagcctggccaacatggtgaaaccccatctgtactaaaaatacaaaaattagccaggcgtggtggcgcgtgcttgtaatcccagctacttgggtggctgaggcacaagaattgcttgaacctgggaggcagaggttgcagtgagccgagatcacgccactgcactccagcctgggcgacagagcgacaccctgtctaaataaataaataaaaagtgaatttactgaattttgtttccttttttaaaaatcccgttcatctactttaaaaattaaaaatggatatttatttattaaatagaatagatcataaaatattcaattttttattatgttaagggcaaaggaaaaaaatgaagaaaataaagaacagggcacatagaaatactaggaatctggagaaagattttctggagaaagcctctttcttgtgaccttttggcatgttgctgttaaaggctcttcgagaggtactgacatttttggtaagtgtaggtatgaatggatatcacacttgtagttacttgggctctggtccaaatgaagttaagtctggagctgaatctagcccatgagctagtgattcctcatccctaacacagacatcactgatttctcttccagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccgggtaagtacgcttatgaaaaaatgttgccaataatcagactctacattccccagaaatcctcatagctttggaggattactttccttttagtatttcacccttgttctcactattatttacagaggcgtacattctcccttactgaagtgcgtggtcaagtttcggagtcagaagattctattacaaagcagattgaaagcctagagactgaaatggaattcaggtaacagggactatctctaagccattataaaaatttatgcctggaatcaaaaattgaacctattaatctagtgattcaaaagccttgtgatggtggaaaaacacgagaaaataacaattttttttaaaccagacactgtactaggtatcttagatacattttcttattcaatccctttgatgccttatgaggtaagtatcattcttctcatgttagagatctaaaattaacttggtcatatggaagtgggttatcagaacttattaacattagtgtcactgaagttggtatacaaccccctcgctgctaaatttgactggctttttaataaataactggttaattggttaatttttaaaaggaaattcagcaatcttaagaaatttgccaaaggtaattaactggctaacaaacaacagagctgggattcaaaacacactctaattccaaagcccatgctttttacaatacagcacaattttttctctttatttttttaactgataactagagagtcaggcaccataatttttgatgcagtagtgtctctaagatgtagaaccaataacagaattttagaggaaccaaagaaatgataatagaagagcaacaacacagaaggtgaactttagagatcatcaagaaaatagttctaacatggtaagtaaagttgtcatgagcattaaatgaaattagtaaagtgcataacagtacttagcatattagaagtgctcaatgggccaggcgcagtggctcatgcctgtaatcccagcattttgggaggctgaggtgggtggatcgcctgaggccaggagttcaagaccagcctggccaacatggtgaaaccctttctctactaaaaatacaaaagaaattaggtgggcatggtggcaggcacctgtaatcccagctactcgggaggctgaggcagaagaatcgcttcaacccgggaggcagaagttgcagtgagccgagattgcgccattgcactccagcctgggcgatagagcaagactccatctcaaaaaagtaaaaaaatggccaggcacggtagctctcgcctgtaatcccagcactttgggaggccaaggcaggcagatcacgaggtcaggagatcgagaccatcctggctaacacagtgaaaccccatctctactaaaaatacaaaaaattagccaggcgtggtggcacgcgcctgtagtcccagctactcgggaggctgaggcaggagaatcacttgaacccaggaggcggaggttgcagtgagccgagatcgtgccactgcactcctgggcgacagagtgagattctgtctcaaaaatgaaaggcagacagacagaaagaaaggaaaggaaaggaaaggaaggaaaaagaaagagaaaagaaagaaaagaaaaagaaggaatagaagtgctcagtgaaggccgcactttctcaggacctcttgagactgtgttccctgtgccgtggtcactcatattggctctaaaaagtaaaaagaaaaagaagtggtcaatgaatgttcttctgtccctcatctcctagctctagaccagaaattatgctacacaggctcttctaatcatgattattttaagcagtttatgaaatctagaaggaacagaaccttgacagagattttatcgtgttttaggataatagaaccttgggatcatttaatctggttttagcaatacatactaactttatcttgggatacatctataaatcactcaacctttgagttcctgctttgtgctacactggatgcagttgggatatacagaaaaaatagatgacattgcccttgctctcaggtggaaatagtatcattactcacactggtgtcctggaatcatttgctaaaatttcaagaatgttgtaaaccgttgttagtttacaattgattatggtgagaatttttacaccacagaaactgacaaaagttacaaatcagggctggggtttttgtttgtttgtttgtttttgttttatgtttgtttgttttgagacaaagtctcactcttgcccaggctggagtacaatggcgcgatcttggctcactgcagcctctgcctcctgggttcaagtgattctcatgtctcagcctcccaagtagctggaattacaggcacatggcaccatgcctggctaatttttgtatttttagtagagacagggtttcaccatgttggccagggtggtctcgaactcctggcctcaagcgatcggcctgccttggcctcccaaagttccaggattacaggtgtgagccattgtgcccagccaagggctggctttttaagtgctggttattaaaaatttacctacataccatatgcgtaagtaaatgattatgtaaatgtagggctggtgccaagtagaaggaattagaggtgagtttagttaggagaatttttttagaactgatgagacttaaactacattttggaatagataagggacacgaattgtcagagaagacaggaaagggccaatgataggtgacaactctgaagtgttgtgccccacctcttccagaagccttccctgactttttaatccctcactaatcttccttgttctctaaactctttcagaacttatgatactcaattatgacatactgctgacatgttatctttatgtttattgttttatgtttattaattttgtcattctaaagacagactgtaagcttgttgaaggaaaggactctacattagaccagggttttcaaagtgtgggccgcagattactggggagctcatgagccagtgatcaaaactattttcataataatattaaggcattatttgccttttttgctacattggaatttgcactgaaaatgcaaaagccatagtgggctaaagtgctgacaccctaggctgaatgaaagcagtggcaccaacctgaactagtagtcattgtatgcttcaccactatatactctcaggttttaaaaaaacaagccagtcttaattaagaatggtgttgcgaaagcagtaaaagttgttgattttactaaatctggaccctggagttcatgtctgtgttacatcctgtgtgacgaaacaggaagaacacagaaagcacttctactgcatgctgaatatgatggtcgtctcaagaaaagcactgcgattgtttgaggtgtgagctcaataggcctcttttttcatgggacatcatttttacttaaatgaacaactgacagacaaactgtggttattaagacttggttacttggcagacattttctcaaaaagaatagagcgagcctgttgctttaaggaaaacagctgacagtgtttgttacctaagacaaaatgtgagctttcaagcaaaatttggatttggaaaacttgtatctgccactgtgaacttgacagtttttcataacttttctgataagaccagtagtgatattaacaagtgtgattttaaaaatatatattttatagaatgaaatgtgttaacatttggaagatctgcatgactctggagtaatattgtccaaatggcactttatagaatgatgtattcgtaaatgagccattcagattgcaagatagactgatgaattttaatatgagagaatataaaaaagtttatggaaatcatcattctcagtaaactatcgcaaggacaaaaaaccaaacaccgcatgttctcactcataggtgggaactgaacaatgagaacacatggacagaggaagaggaacatcacactctggggactgttgtggggtggggggaggggggagggatagcattaggagatatacctaatgctaaatgatgagttactgggtgcagcacaccagcatggcacatgtatacatatgtaacctgcacattgtgcacatgtaccctaaaacttaaagtataataataataaaataaaaacaacaacaacaacaacaaagtttattaataagtttcagattcaacattgcaactaactcttttttttttttattatactttaagttttagggtacatgtgcacattgtgcaggttagttacatatgtatacatgtgccgtgctggtgcgctgcacccactaactcatcatctagcattaggtatatctcccaatgctatccctccccccttcccccaccccacaacagtccccagagtgtgatattccccttcctgtgtccatgtgatctcattgttcaattcccacctatgagtgagaatatgcggtgtttggtttttttgttcttgcgatagtttactgagaatgatgatttccaatttcatccatgtccctacaaaggatgtgaactcatcattttttatggctgcatagtattccatggtgtatatgtgccacattttcttaatccagtctatcattgttggacatttgggttgcaactaactcttaaggaggtaccgcttgttgagttttagtgtagtctcaaagaagactatttgcagttatctgaaaaggctattaaaatactccttttcccatctgcatattcatgtgaggccagattgtcttcatttacatcaactagaacaacatgtcacaaaagattgcatacagagggagacataagaatccagctgtcttcaactaagccagacattacagagatttgcaaaagtgtaaaataattccttttcttactatttattatctcagaaaatgctacttttcagaaaatatgtaatgtataataggtttatgttttttttttgtttttgtttttttgacagagtctcactctgtcacccaagctggagtgcaatgacgtgatctcggctcactgcaacctccacctcttgggttcaagcaattctcctgcctcagcctcccaagtagctgggattacaggcacctgccaccaggcccagctaattttttgtatttttagtagatacggggtttcaccatgttggccaggctggtctcgctcctgacctcaggtgatccacctgcctcagcctcccaaagtgctgggattacgggagtgagccaccgcgccccgccaataggtttatgatttttttttttttttttttgagatggagtcttgctctgtcgccaggctggagtgcagtggcacaatctcagctcgctgcaacctccgacttgctggttcaagcaattctcctgtctcagcctcccaagtagctggaattacaggcacacgccaccacccctaactaatttttgtatttttagtagagacagggtttcaccatgttggccaggatggtctcgatctcctgacctcataatttgcctgcctcggcctcccaaagtgctgggattgcaggcgtgaactacctcgcccagcctaggtttatgatttttaagtgaattaattttttttttttttgagatggagtattgctctgtctcccaggctggagtgcaatggcacgatctcggctcactgcaacccccacctcccgggttcaagtgattttcctgcctcagcctcccaagtagctgggattacaggcacccaccaccacgcctggctaatttttgtatttttagtagagccggggtttcaccaggttggccaggctggtctcgaactcctgacctcaggtgatccacccacctcggcctcccaaagtgctgggattacaggtgtgagccactgcgcccagctaaaatttttttcagttgtactttctaatactataaatctctataggtataacacatgtgaacagaatgtcctagatgtcttcaataatttttaagggtgtaaaggggtcctgaaaccccaaaatttgagaactacagtcttagattattttcatacccatcttccttatagtaccaaacttatcactgcatatgaagcacatgctggtatactctttctcactagacacagaagaaatttgagaagaaagctattaattaaactgaaatactgtgtagattttggtctaggacatacttgatcagaaagtacccagaagctataaccagggtcagaatatctagtcttcttagaaacttctcggtcttgtggcaggcacatcaagataacctctcacaatgccagccatgggtatcattttggtacttgattgtagtaaagagcatatctacctgttcttttgagctttttccttcaagtctccaacctgaatcttatccttgcatgggtggaccatcatgtcacagtctgagcttatatggcctcaagacaaagtaacatattatacttaatccactacaacaaaagccttactgtgataagtctttccaagtcccactttatgacccatttatttcaaccagtatttaatggaataaaaccatttaaatagtctcttagagtccctttgttacaagatttgcgatactatgtaaaatcctaaccagatgacttaaacattatttaaatgatatttaactgatagctccatccataaaattatttgaagtttctcctcagagctcttcccccttcttgatgttcaggctacttgcaataaggcttactgtttctttccctgaaggagtgctcagattgctgacctacagcagaagctgctggatgcagaaagtgaagacagaccaaaacaacgctgggagaatattgccaccattctggaagccaagtgtgccctgaaatatttgattggagaggtaaacatcactctaaccagcagttaggaggctggctgtgtaggttgaaatgggatgttagccttgaaatattgtcaaagtgttattgccacttttcatggtagaaaccctaataacactaacattagagagtttagtagataaaggttggtgtaagcaagtacaggccagtcacttacaaaaatataatatgactcacaaattgatgcccgttgtgactggcctatagcaagtgctgaatgcgtgttagctgttgttattaggaaagaccagaatgccatagtgggtcactggctaaacatcaactgttatactgtactactttttaaaacccctatgagatgtatattcaaaaatttaagatccagtctagaaaagggaaaacctaagcatcttttgacatataaagattcattttagggaaaagccatctttgctgaccttaaaatgatatgtcaccttacgttgtcacaagaggaatgaaaattgattgcctctggtgattgaagcattttcactcaagataagcatacaaactccaaacccacaagtttaaacaatgctaccctttatacatttttgtgttagcttagcagatttgttctactaaggaaatcttgatcagtcttgtgaacactggtacttatgatgttcaccatctgggctagtagtgaatgtaaaactaggccagtgtaggatatgtagcctgaagagccagatctgcagtctcagtctacaagttctaacatgtgaatatagacattctgaaatgggacataattggccataagggtgtgtcctgtggattttgcttaaaaattaaggaagaacttcttaaatatcagaatttgtaattgtcagatactattcgggttagctttattcttgccttgaggcagagcaagaaataaaatggccttagcagtggcttctagccccaagatacatgtctcagcagaaatgtggactcttggcctgggaatagaacaatagtatatttactattcaatgttggaatccatatgacatgaaaaaataagaatagacttgaacatggaggaatttttctcagaccctttcaagaaagctgacattatcctgcctgttgaaagggggaaagaaaggtggtcattcttcaaataaactgatcttcttttattccttccagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtaaactctagcaagtcaagaagctatactgtgaaactatcattgccttgtattgttagttttaaaaaaaaagtggggatatgaaatttctttcaaaagtccacgtggccttttctaaattttgcaaataaaaagaaacctgaagcagagacgtgacttgtctaactttatacataccagtgacaatggctctgggtttccaacttaaatatgaatattaacaatattaacatgctgagaaacaggcccagcgtggtggctcgtgcctgtaatcccagcactttgggaggccaaggcaggcagattgcttgagtccaggagagtgaaaccccatctctacaaaaaattacaggaaattagctgagtgtgatggtgtgcacctgtgatcccagccactcataaggctgaagtgggagaatcgcttgaacccgtgaggcagaggttgctgtgagccatgatcgtgccattgcactgcagcctgggcaacagaaagaaaaaaaaaaactatgctgagaaacatccatgctgtacttactacttcatgccatgacagcaaatgagaacagtttacttctaaatcacaagagagcagtcacctggatcactgcttgaactaagtcaaaatttctttttccccttggtacctttgttaccacccattggatcgtgtctttctctaggtgctgtaccttctcagccagctgcagcaaagccaaatggcagagaagcagttagaggaatcagtcagtgaaaaggaacagcagctgctgagcacactgaagtgtcaggtatgatcacgagaggtctccagagatgagtttcacagtactaactgagaatcttgtctcatttagacccttgtacttgcagcagagagtaattaactactggaaaaagtatttataatggtagcctctactgcttttaggccctatttgatcaggttaggggtgcttagagtgtagccatatataggaataacctcattttgggtaccaaaatggcagcacatactccatatcagactctgaggccttgtggttcttggcgtcaaccctgagctctaaagagttgaggaagtgaaatcatccagtagttacttagaatcctagggccattcaaatggtatgaagagcttgttcttctgtgctgagacctgacatatttgtaaaatgcctggggtctgaatttcttccagaggctaggaacaccacaccctttagtggcatgttgtagcactattttagtctaacttagaatctttttcctgaaccaccagtctgtagggtttccttggcaccttccatctaagacataagcaaactagttaaggttgtatgcatgaatctgggtgtcttaggtgccaggtagttcggtcaggcttactaaagtagcaagtaaactgcctagtctatgttgagaagggtaaagagaagcatctatagacttcaagaaaatagagctaagtttctgcgggtttcttaatcagcatccgaatgtgaataagggatatgaagctaaggaatggaaaagaataaggaaggcttgtcgggcagagtccacggttcctatgaatgtggtcagagctgctggggagcattggaatggaagtggcattcagggcacctaggaactgggaatcagacatttttctgggtgccagtgcctgctgtgcaaaaaccatctgctgccagcaacttggcagcagtatgttttcatctatgtgagttgtttggtaacccacatgtagtgcccaaaataaccccatatatcactgcactatctggaaataggatgaagaacttgagaaaatgcgagaagtgtgtgagcaaaatcagcagcttctccgagagaatgaaatcatcaagcaggtaatacagtttcccacccacttgataagccctaagagaccccgttgctactgaggccagctcttgggaccaacccccattgtggtgacttggctttatttcatgaggtctacatttagtttccatgtgacatatgcatttcaaagtggaataaacataagtttttaaatttgccattttctgaatctaatattgttgatattggaaagtgggagtcaacgtactctactataatcctgcatcactttactatggtttaacgttaagctagcctaggtctggtatctgttttagccatgaacactcccagaagctgccctgcattatatactttgtctcttcttttcaaatagaaactgaccctcctccaggtagccagcagacagaaacatcttcctaaggatacccttctatctccagactcttcttttgaatatgtcccacctaaggtaaaatgatcagtgcctgtgatacctttgcacagcttaggtttggggtgagtgtgctaaaattgccctttataagaggttgacagttaaaattcccaaattctagcatctcacttttctttggagtcccagataaaactacagttcaatcctaaggaaagtaggcattcttactcctcagaaggctgactttgggccatggacaggcattacctaacacaactgaggaggagggacaggagaaaagagcaataatgttcagctgtccatccaaagatacttatctcatcatatcatgagtttccctttcctccctcagattggtcagcctccaatttcactgccttcaaagactctgcaaagccataggctaaagcagaatttcttctgattggtaaagccaagtggggtggatttgagagagtctgaaatctttgctctgagaatatagctggcaacagctactgggaagatatgatgcatatatagtttttagtttttattaaataactaaactactccaaaccttttttcctagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaaggggtaggagccagctcttcaactttttttttgttttgttgttgttgtttttggagacagagtctcactctgtcgcccaggctggagtacagtggtgcattctcggctcactgcaacctctgcctcccaagttcaagtaattctcgtgtctcagcctcctgagtacctgggatcacaggcgtgtgccaccacacccagttaattttgtatttttagtacagacagggtttcaccatgttgaccaggccagtctcaaactcctggcctcaagcaatctgcctgcctcagtctcccaaaatgctaggattacaggtgtgagccaccgtgcccggcctagctcttcaactttgtcaggggttctaattcttagtattcattcactgccactgggatagttttctgaatctaggaatgtgttggccccataccctttagctatcatttagaggcactgactccactaaaggggggcttgttgggccatctttgtgtagaacctggggctagtatagagggctgcttgagtgcacaagttggctctcttcttgttttcaggttcttatcaatttgaataggtaatgttccataccatttcattgaagctgatcccaaaatgatcataacaattcttcatgtttttatagcactttacagtttataaaccattctcatatatattaccacttttaatcaccacaaaaaatccagtgaagggccaggcgcagtggctcacgcctgtaatccctgcactttgggaggccaaggcgggcagatcacctgaggtcgggagttcgagaccagcctgactaacaggaagaaacctcgtctctactaaaaatacaaaattagctgggcctgatggcgcatgcctgtagtcccagctactcaggaggctgagacaggagaatcgcttgaacctgggagggtggaggttgcagtgagccgagatcatgccgttgcactccagcctgggcaacaagagtgagattccatctcaaaaaaaaaaaaaaatccagtgagatatttactatttgcattttccagatggacccccgacccacaggagggaaatgaccttgcccaaggtcgtaaaactaagtgatagtcaggacttgaaaccaaatattctgactccaagtccagtttgtttcccccacatcatggttatgtcagtaaaaaccatagaccagaagttgagtgggtactttatctttgcctaacagagtaattttactctctaggctaaggaacaaaaagaattacagaaaaagctaataattaagatcaaacacactaagttaaggctacttaggaacaatccgacttaggcatgctttattttcttatacaatgatagtcctactcaaacctagatgttttatgttgaaacattaacttcccaggcattacagttcagcaccactacccccaactgtgccctgcagccacattccacttaaagagaacagttcacaagttatcttagctggcttcctacattatttgatttgattagcctatagctcatcacctggggaactaagccttataaacccacaccaccaggatgaagcaagtcataagatatagacagccatggtggtaagtcatttggtcagtcagaatcatcaagaatgcaacatatcatgtgctcatagtgaaactaagagctcatccttagcttcagagagtttataatctaatgggaaaacaaggtaaaggaatagaagcctaccatagaacctcagcatattcgtctcagggagatggaccggggagtttttggtttgtttgttgtgttttttcttttgagacagagtttcactcttgttgcccaggctggagtgcaatggcacgatcttggctcaccacaacctcctcctcccgggttcaagcgattctccagcctcagcctcctgagtggctgggattacaggtgcccgccaccatgcccagctaattttgtatttttagtagagatggggtttctccatgttggtcaggctggtctcgaactcctgacctcaggtgatctgcccacctcgacctcccaaagtgctgggattacaagcatgagccaccgtgcaagtttttaagagtgactataaagccaaaccaaggaggtgtaatttaagaaaatgccatgaaagaggtgactattgctgcgttgtaagacagaaagggaaatacagtcttgggagcaactgggagacatttctggcacaatgaatagcatattcctaagacttgaagatggtagtggaacagagagttgggacacttagagaaaatggggcagagcgtgtctctttctttcatttactcaacaaacatttatggacgttttactatagttgaagtagagagcatgagctgaatgtagattaaaaggtcagctaagtaataggaggcagagttgagaagtacacacagaaaaatggtagaggccaggcgtggctcatgcctgtaatcccagcacttcgggaggccaaggcaggcggatcacctgaggtcaggagtttgagaccagcctggccaacatggcgaaaccccatctctactaaaaatacaaaaatcagccaggcatggtgacgcatgcctgtaatcgcagctacttgggaggctgaggcaggagaatcgcttgaacccaggaggtggagatggcagtaagctgagatcacaccactgtactctagcctgggatacagagcaagactgtctcaaaaaaaaaaaaaaaaagaaaagaaaaaaaatggtagagggcctaaagccctggaaaggaatttccaaatatgaggtgaatacaggtatacttgtcctcaaggaaagcttcatatatttattagagcactgttgctctaagcttaaaagggcaacatagaagtatagcaaatattgcagtaaataatatttactattagtgataaatcctacgtctaaaacaatgaggaattactgttttctaggcttttcccctgattttataatttggaaagtgaatataactgggctttaaagggaacaagttagcataaaatctggtttctctaaagttaccttttggcagtctgaaagtacatggatactatgactgctctttgatcagactgcttgcagacatattacctgtagaacttgatgcttcacagaggacctttattattactgcttcaacccagctgaagctggctgggactatcactagattactgaaaaggagactgaagcaggcaccaaaatgatgacttgtccagagttaatggcttcctcactcagccacatttcctatatgtactaaggagatgctggggggtaagtcatgtgctatcatagaaaaagtagtaacctagaagccagatagacatgggtcttgagtttgccacgggttcattgagtaaccttgagcaagtcagtctccctgggcctcagattccttacctatgcaatgcagggtctagaacagcggtccccaatctttttggtaccagggaccggtttcgtggaagacagtttttccacggactggttgtgggggtggtttggggatgaaactgttccatctcagatatcaggcattagttagagtctcataaggagtgcgcaacatgtgcagttcacaacaggattcttactcctatgagattctaatgctgccactgatctgacaggaggcagaacccaggctgtaatgcttgctcgcctgcagctcacctcctgctgtgtggctcagttcctaacaggccactgaccagtactggtccccagcctaggggttgtggaccccctggtctagaacagattatgtataaggttccttctaggactaatatcctgagtcaaagtaacagtcaaagttgtgtaaatgggttttaataacaatgcttttatatggtgttatatggtatctgaaaagttaggaggaatatatgcaaaagcaccttgtgaaggatacagtatcatgcagatattgttgttaaagcactgtaagcattttacaaatattctcatttgtcacatttggcagaaaagaggaagcaggtatttttgcctctaccttactgatgaaggaatagcctgggcacggtggctcatacctgtaatcccaatacttggggaagccaaggtgggaggatcacttgagcccagagttcaaggctgcagtgaactatgattgtgccactgcactccagcctcagtgaccgagcaagaccccatctctaaatttaaaaattaaaaaaaaaaaaagaatggagattaacttggatgaagtgacttgtccaaggtcatgccaagcattaaatataggactagagcctgagtctcctaattcctagtctggtattctttgttttttgtttttgccacagcatcacttaccaatcctggtattttttttttttggaccagatctcatccttctgaagtatgaggtacagtgtaacactgagcttggtgctagaggaattatggactctaaagcagtagttctcaagtctagccacacattggaacacccaagggagcttttaaacatggagcctaggactccacccccagatattctgatgtaattagtctgaggtaggacatggactttttgaaaagctccccagagatttcttatgtgcagccagagttgagaacaactggcttaggggaaacccagactctgctttccactctctacaaagaatcccttggccgggtgtggttgctcatgcctatcatcccagcactttgagaggccgaggtgggaggattgcttgacgccaggagttcaagaccagccttggcaacatagcaagatcccatctctacaaaagaaaaagaaaaaaaaaaagagtccccctattacttctcaactacggtgctgggacatgctggtgggttgccagcagttgtgatacacacacacacacacacacacaccaccctgtatacatgtattaaatacatttgtagttatgcctgtgatagggacacattctgtctttgacattctaatctgcttcttggtgtgagagagaataggatgaagttacagctcatgtacctggcattcacgcaactacatctgtcatgtatgtcatgactgtgctataataccactaccaggtatttatctaacctcttcttgcttgaagacttctagtagggggaagctcacagtcttataggacaacccattggattccactaattgttagaaagttacttcttgtttagctgaaatgtgctgtcctatacatcatcccagtaggtcttggctgtgtaagagcctaatcattctttatgacagcccttcagatactgctttcatgatattatccctaggataaaatagagaaacatggatgaggtaacagcatttttgaagcatttagatgaatttgtaaatggccaaaggaccatacccaggctgtagcaatcaatggatcactgtcatcctggtgaagtatcaccaggacatgtcatagaactccatctttcatcctgtcttaaagcagcaaagattttttgttatgataatgtctagcgttggcaagggtgactaagaagggcacttctggccgggcgccatggctcacacctgtaatcccgacactttgggaggctgaagtgggcagattacttgagcctagtagtttgagaccagcctgggcaacgtggtgaaaccctgtctctactagaaatacaaaagattagcctggcatggtgacacacacctgtagtcccagctactcagtgggggctgaggccacaggatcacttgagccctggaggttgaggctgcagtgagctctgatcatgccactgcactccagcctgggtgacagagtgagaccctgtcttaaaaaaaaaaaaagaagggcatttctgtattgctattaggaatataaattggtatacctttcaggaaggcaacttgaaaatacgtatcagtagcctttaaaatgtttctatcctttgacccagtaattttacacatacaaatttatactgaggaagtagacattggtatgtaaatgtatttattcgtttgacaaatttttttctgagcacctatgtgccaggcactgtttctagatgctgagaagacatgaaacaaggcaggtgagattctttaccctcatgaaactggtattcttgtggggagagacacatggtaaccagaaaaataaaataattttagatagtgatgagtgaaaaagaaaagaaaatatagtgaagtcatagagaatgtgggatgggaaaagagcactttagaagagtgcttggggccaggcgcagtggctcacgcctataatcccagcactttgggaggccgaggtgggcggatcacttgatgtcaggagttcaaaaccagcctggccaacacagcaaaaccccatctctactaaaaatataaaaattagccgggcgtgatggcgcacgcctgtaatcccaaccactcaggaggctgaggcacaagaattgcttaaacctggcagaggttgcagtgagctgagatctcgccactgcactccagcctgggagacagagcaagactccatctcaaaaaaaaaaaaaaaagagtgcttgggtaggccgggcacggtggctcatgcctgtaatcccaacactttgggaggctgaggtgggaggactgcttgaggtcaggagttaaagaccaggctgggcaacgtagcgagaccccatctcactaaaaacaaattttttttaaagaagagtgcttgtggagctctctctgagaaggaaatatctaagctgaggcctaaacagtgaagagcaagtcaggaaaagcatcagaagaacatttcaggaaaagggaacagaaaatgtaagacctcagggcaggaatgagcttagtatctcaaggaacagctaaaaaggccagtgtgactagaatgtatcaagcataagctacagtcaggggatgggtagtcaagggccagatcatggagggccttgtcagtcgtggtacagtttagattatatttctatacaaggatatctactgcaacatgatttataatagtgaacaatttctttcaaaacaatcttaatatttaacattaggggactggttaaataaatcgacattatccccatgaggaaatatatacaactattaaagtcaagttttttgattttcaaattttgtaaagtgatatatattattctgctaatcagaaaaaaaatgttattgtggtttctacagagcaactacagagcaaaggtgatggttctcatatgaaaaaaacttaaaggcttgaatttgactataagctcagtatgaatccacaaagatgtgacaggaaaaaaaaagcaactgattttaggcctcatgaacaggactactgggtccataacaagggaggtgtttatcacagtccacctcacagtggccacaccacatttagaaagttgtgctcatttctagatctcacaattgaagaactttgacaaattggtgtatagtcaaggtggtgaggatacatgagaaccatgtcatgtggcaaatcattgagggaactaggtacatttaactttgagaggatttggacagaaggggactggggagtaaaaattacgttcagggtttgaacagttattctataaaagtggggttaaactgattccatgtcattttagatggcagaattgggtcctatgattagaagttatatagaaactattatcacctcaggataaatagagcttcagataattagaccagggatgttaagaggggcttcatacatcaaaccagtctttaggtggtcgctgaggtctcttctcactctgttccttcatcctgtgagctcagccacctctgtcttttcaaagccaaactatcccactttcttctacgatttttcttatagcattgcttcctataattctgatcactcacctcttttttgtttaacatcctctttataaaacatacacactgacttcctgaatgtgtatacaagaaaacatgcttattgattaaactggtttaataaatggaaagcccttatagcagtgcctggcacacattaatgttagctatcactactgcagccttgtttataagaatggaaaatggcactatcaggagaatgggtaaattgtggcaacttcatagagtgaaaatgaatggaattgaagctatatgtatcaacatatgtcatttatacaaagtttagaaacgtgtaagacaatttcttgtttgtttttgtttttttacaaaaactcttatgtgtggctaggtgctgttgctcacgcctgtaatctcagcactttgggaggctgaggcaagaggattgcttgaggccaggagttcaagaccagcctgggcaacatggcgagaccctgtctctacaaaaccaaaaaattag

SEQ ID NO: 5712 - DNA, 130742 bp, human
ctccggctgggacagggcggcgggaggcccagggagaacggggaagggacatttagtttggtgagttacgggggcacaccttagctcagaacctgtttttacccagtaccctagggctttggttctttgtcgccgtccccgttggagttttttctttgcctttcagaagcccgtgcactctctttagagtgcagggctgacgggcggtccagccctggccaagtcatggagcgtgaatctcccaagtcagtgttcccgctgaggagggtcggaaccggggaggacgccctcccacccctgctgacctactaacattcatcagcgagccttctttttccccctcgcagagacggtgctgagataggatcatgaaggaagaggtgaagggaattcccgtaagagtggcgctgcgttgtcgccctctggtccccaaagagattagcgagggctgccagatgtgcctttccttcgtgcccggagagcctcaggtgcgtagcagagtccagagcctgtgtctgaacagctggggccaaatggtaacgaggggtgtggtcttgcctttcatttttaaccttacgccttgtcccgtgccttctctaggtggtggttggtacagataaatccttcacctacgattttgtatttgatccctctactgaacaggaagaagtcttcaatacagcagtagcgccactcataaaaggtgtatttaaaggtaaggcgatttgattcctcgaacgtaacatatatattccttgagcatatactatgtgccaagcactgtgcttgggcactgcaaatacaggaatcgatgaatcatgattcctgccttcaagaagcccttagcctaataacatttgtcaacgtctctgtacccttgaagctagttttattctgtatttgctttatgtggttctgttcatctttgacttgtatatgtttgtttatcctggaacttcattagattataaactctgtggtggttgctgatggtgataagtgtgccaacctacttgaggcccaggcactgcaaagcttgttgagggattcaggtgataaataatatagcttcgaggccctgaaggagttcaaagtccaggggataggaatggagatagatgactacataaataattttgaatatataaaaatttttaaattttttgtacctatcttttagaagaaaaatttttcaagttaaaaatatacaacagagtcagtcctatggaagtagtagctctgctctcatacaaagtggtatgaaaaacaaaaggatggctctaactctgcttggggaatttggggtgaatttcacagagtgggaaaactttgagatgggtcttgaataatgagtatacttcttttaggtggagaaggggagtgcctaaagcctctgaatactatcaccagttaataatctttactggggaagctaagtctttaatgctgttgaggaccatagcagggttctaaagaagggagcagtgcctgagagatgtctaattattattctaatacagtggttattcaagattcaaaacagaggttcgtttaaaagaagtagaatcatggcatgctagtgccttaaagttgaaagagacatttgtatatcatctagtttgtttttcatccaaagaaaaatgcgttctaacaatatctgttaggtgaactgccagtgtctaaaatttttttgacagggaactcactgactcacaggtagtccagttgagatttgggttttggacaagtctaattatgttataaagatctttataatgagatgaaatttgcttcctggtaatttctacccagtgatgttagttcattcctttagaagccttcttctaggcaacagctattcacatattttttcacgtttttttgtttaatgatatggctcaaggaacactgaaatttttgtttcaaaattttaagatattaatgcaataatttcaaacgtatagaatgttgcaagaacagcataaaaaacattttttccctgaaccatttgagatgaatcattggcctgataaccccccatactttagtgtatatttcctacaaaaaaggactttcttctaagttaccacaatacaaccatcaaaacaataaaatttgcactgctacattactaccatctattcctgaaaccccattcaagtttcaccaattgtcccagtaaatattttatggcaaaaagatctagttcaaaatcacgttttatttagttttgctgtctctttagtctccattctaaaacagttctttagtctttttttgacttttatgagtttgacactttgaagattacaggccagttattttgtaaaccttttctcaatattgttttgtctggcatttacttatgattagattcaggttgtgtatcttttagcaggaatatcacagaagtggtgctgttttcttctcactgaagcctattgggcagcacatgattttgatttattctattactactgatgttcattttgatcatttgattaaggtgttaatctgctgggcttctccactataatctttttcctttttacatacagtatttggaaaaccgttaagtgtttctacctaattctcttcaattatccccgcctttcctttagccattcctgaaacaatatgcttttcagaccctgcactatctggtcagattcctcaggctatacctccacagcttagtaagagcaccacagttctacttttacattcttaacttgggaaactgatagaattaaattatgttctttaaaggcaacataaagtagaaagtgattccaatatacatgtgtttgcttaacattacccttggttgcaaaaacaaagtcaatattttttatagtcagctcaacagcaccctcttgtactctgaactcctggtaccacagagccctaagtattttgtaaaaactactaaaacctcatttcccaagttattgctatctgcacatatctgtggtattgcagaaaattatggaatgttattctcttgccccatagtcatgccagctgataccagcggtctattacagtgaaaatctcaatttagcatcttcttatgatccttcatttagaccaacaagttttttcaaaacttcaaagttttcatttagattaaaacgttgtttcaaagtttaaagggttttttccttcagactgcaaaattatcttggtaaatagcagataacagctttgacataaatatgatgatcatttaacagagaaagcttgctttgtgttccttgacaacatgtctgccacactaataaggaacagacttccctaaggtcattatttttttcaccttgaagtaaatttgcatttgtagttccttttaggtgccatgcttatagttttagaagctactactgtacaattaagtagcaagttataattatgcatcagttaacgacagggataccttctgagaagtgcattattaggcggttttgtcattgtatgaacatggtggagtgcatgtatacaaacctagatagtatagcctcctatacacctgagcctactgctcctaggctacaaacctgcaaagcatgttactgtactgaatactgtaggcggttgtaacatcatggaaaatatttgtgatctaagtatagaaaaggtgaggtaaaaatacagtatgaaaggtaaaaactgatacacccgtatagggcaattaccgtgaatggagcttgcaggactggaagttgctctgagtgagtcagtgatgagtggtgagtgaatgtaagggcctaaaacattattgtatactactgtagactttataaacactggatacttagcttacactaaatttattaaactttgtgtctttcttcaatcataaattaaccttcgcttattatacgttttttactttataaactttaattttttaaatctttttgacttttttgtaataatacttagcttaaaacacaaatacattgcacagcggaataaacattttcactctgcatctttattctgtaagcttttttctttttaaaaaaatatatttttttactttttaaactttttgttaaaaactaagacacaaacatacacattagcctaggcccacccagggccaggatcttcaatatcactgtcttccacctccacgtcttgtcctactggaaagtcttcagggacaataacatccatagagctgtcatctcctatgacaacaatactttcttctggaatacctcctgaaggacctgcctgaggctgttttacagttaactttatttatcataagtagaaggagtatactcttaaaaatgataaaaagtatggtatagtatactaaacacataaactagtaacaatcatttattattatgaagcgttacatactgtacatagttggatgtgctgtacttttatatgactagcagtgaagtaggtttctttaccccagcatcaacacaaacatgtaacatgttgcactgcaatattataatggctaagtcaataagcaacaggaatttttcaccatcgtgtatacattccacatgattgaaatgctattatatggcacacgactgtaacaattgaagttaaagtaagaataacctgtctattgtctaattgtttctttataaaatcttgctacagttgtttatcttcctctagcttcaatccaaactttgaatttacgggataaaacgaaaatgcccgctgggcatggtcgctcaagcctgtaatctcagcactttgggaggctgaggtgggcagatcatttgatgtcaggagttcgaaaccagcctggccaatatggcgaaactcgtctctaccaaaaaatacaaaaaaattagctgggcatagtggcgcgtgcctgtagtcctagctaccctggaggctcaggtgggaggatcgcttgggcctgggaggcgaagccgtgatagcacacactgtgctgcagcctgggtgacagagtgagaccttgtctcaaaaaaccggggagggggagtgctgagtaactagtaatctggattatctgacaagagaaaatataaaaactaatctacaaaataaacatttttaccagaactaagcccaaacagaaatatacttttttttgaaaccgaatctccctcagtggcccaggctgaagtgcagtggtgcgatctcggttcactgtaacctccgcctcctgggttcaagcaattctcctgcctcagcctcccgagtagctgggaccacaggcgcccaccatcacacccagctaatttttgtgtttttagtacagatagggttttgccatgttggccgggctggtttcaaactctgacctcaagcgatctgcccgcctcggcctcccaaagtgctcgattgcaggcgtgagccaccacgcctggccaataaactcaaacagaaatatattttatgggtctttctgcaaacagtactgataacataagtgataacgaaaaacacagcctctgttcaataatgccttctatttaataatttaaaaaatacaaacgggggaaaagaaaacacaaaaaatttaccatcctatggcttggtgtggtggctcacgcctgtaataccagcactttgggaggccaagatgggcggatcacaaggtcaggagatcaagaccatcctggctaacacggtgaaaccccgtctctactaaaaattcaaaaaattagctgggcgtggtggcacgcgtctgtaatcccagctactcgggagactgaggcaggagaatcgcttgaacccgggaggtggaggttgtagttagccgagatcgcgccactgcactccagcctgggcggcagagcgagactccatctcaaaaaaaaaaaaaaatttaccatcctatttctcagagataaacatcaaaataattaataatttatatacttttgatcttttcctatccatacactcatatttaacaattatttttaagctgcttttttcagttaactatattgtgaacatctttgaataaatgatgcttttttttttttttttttttgagacagggtctgctctgtcacctaggctggagtgcagtggcttgatcaaggctcactgtaacctctgcctcccaggctcaggtgattctcctgcctcagcctccaaagtagctgggattataggcacctgccaccatgccctgttaatttttgtatttttagtagagacagggtttcaccatgttgcccagtctaatgttaaactcctgagctaaagcaatctgcctgcctcggcttcccaaagtgctgggattacaggtatgagtcacggaacctggctcattaatggatgattctttatcaattctcaataaaagcaaaggcatatatcacattgaattatgcttaaatgatgatatttctgtaagcagcctgataatatggttcaaatgcattctgagagttcagatatgaagtagatgctttcattgactgtaaaaagcaatgttgtttccttttcagataaatactgttaatcaagaaaatacatgccagaatcctttctttttctttaatttaatttctgtaatttaaaattgcttaaggtaggaagacagaattttcaagctccaatggcttttgacagtggcttggccaccttcatttagtcagtcatatcttttaagtgtttgatttcttagcttctaagggctatcactacggggacacattttagggttgggttttgttttgtttttgtttgttttttgcttattttgagtagtgcaaggtcatggtacccacagaacttttctttgtgtctgccattcttaagagactgtattaagagagcaatctcagttttattacaaataattgctgaaggaaatggagtatattgattagatgaaaatgtttaaacaccactatgcatgtgacgtctattttgtcaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagaggtaagcaatttatgtttaattattctgaattcgaaattgtctttgggtcgaaaaataaatccaaatcaggtttttcctgacatgactcaaattagtaagttgcattttaattaattgatagagaaaacttactgactcagttggatccggctcccacccagttctttccttggtgttagaatagtctgtttaatttgattgttggaggaattgacattgccatataaaaggtgataggaattctttaattccagtttggcctctgttactgattacctgtatagtctgcagaagagtgtttgatttccctttactgtttaagacttaaatgataatgctgttgcctcatgaagaatgttaaaaaccagctgaaatattgagctgtataagcggtgatagagtgtgtttattaaacagatatttactgagaacctaccatgtgccaggcccaattctaggcacttgggtatatgaggtacttggtatatatcagtgaacaaaacaaaaattctagcccttatgggagtttgtgttctagtgtatattagtatagttgtagactggccaattgtatctaacttcataacatcaaaaacacatctttagggaactgatggcttctgggaagctagctacttgattccatagcagtgatgtcttatcctttagggggtaataattaaacttatataatttaagcatgtgaacacttaatcctgaagttcaatctcagcatgctaacaggtaaagagatgtagaactggaagacaggggattacatcattaagattagccttcttggccaggcccggtggttcacgcctgtaatcccagcactttgggaggccagggcgggaggatcacttcaacccaggggtccgagaccagcctgggcaacatagtgagaccttgtctctacaaaaactttaaagattagccaggtgaggtggtgcatgcctgcagtcccagctgctcaggaggctgaggtagggtggaaggattgcttgagccccagagtgagaccttaaaggcaatttttaattctatttatttatttcttttgagaaagagtcccactctctcacaggctggagtgcagtggcaaaatcatagctcactgcagcctccagctcctgctcaagcgatcctcccaccccacctcagccttccaagcagctgggactacaagcgtgtgccacttcgcctggctaatttttaaatttttgtagagacagggtctcactatgttgcccaggctggtgacagacccctgggctcaagtgatcctcccattttggcttcccaaagtgctgggattataggcgtgagtgactgtgctcagctagattagccttcttgagtctcttgattaacctagttgtggccaacataattgaatatcaaaataactccagatcctggtatgttaaataatagcaatagcagtaatagcaaacacatgtagtgcttagatgtgctaaacactgttctaagtacttaaaattctgtttcatattgaaatattagctgccacttcttccttttccatccacccccatctatgtacctgttattcacattttaacaaaatgggtgaatgtaatgctattatgatgccatcaaagaactgaatttgcgtggtcatgtaacttttcatgtgtctgctgttcctaagagactgtcttaagagagcaatctcaattttgctacaagtgatatgtgaattcattcttataaaacatcaagtgattacctatagggttatggtccttttcttaattctacaagtaatacatgttcattatgaacaaatgtttaaatatagaaagtcacaaataattttaaaaattacctatgatctcaccacccagagattaccactgttaacatcttgtttttgccactttattttcaacaatatcagatttacaatgaagaaattttggatcttctatgcccatctcgtgagaaagctcaaataaatatacgagaggatcctaaggaaggcataaaggtgtgtttgtctctcatttgatgttattaaaaaaatttggcaattataatactaaagttcacatcccttttatctgccactgtggttttaaatgactactatcatctcagtcaggttttctgtggtcctaagtccctttgttaatctaaaatttctaggtgggagctcttgtggggaagcaaggaaagacgcatgttcagttttatcaccttcctgttacctagaggaatgccaatatcaattaaatattatttacagagttctaaggctgagcagtccagtatgttagccactagccacaagtggctatttaaatttaaatgaattaaaattgaataaaattttaaaaattcatttcctcaggcacactagccacgtatgaagtgctcgatagctacatatggctagtggtaaccatgtttgagagcacagatagatacagaacatatccatgtattttcttctgggtcattgttagccagctactaatgcatggatatgattgaacatatctatatccaatagaaaattctgttggacagcactgtaatagacattttgctgggctttgggatgatatttttaaaattgaaaagttaaactatatataatttttaaaacatgtaagtatcataggaagaagagatagcttatttgagaatcttctgtcagatggtatagatgcaagatgaggagctagaactgaacagaaaatgtgaggcaaaattgagagtttcctatgtgggagtgagccaaatccagaagccagtgttgaaaacaggcagagcttgagtattcaggagtgggaaaatcagaggctggaggtagatgaggctaggtagtactctggaaaacttggaataatatcttactcctgttctccttcccttcttctcttgcacaaagaaaaacagagaaagttgaagatttggggtaccagtgagggacaggtgcctgtgctcctgatttttttttctgggtcattaagttgttagccagctactaatgcaaagtttaaaggatcagccctgataagcttggaatatgcaaagatgatttggatagtgaggataagaaacctggacaaaatacatgctattgtactgagccagcacttgaccctgtttcaagatcttttatataccccatgttaaggcaggaattaagtcctaagagttgtttgaggtgagatttgcaatacagagaagtatgagttcctgacacaaattggtaaggaagagtttgtaaacactcttcagatgggatggataggctttaagtaagtagagaaaataaggatattcttatggtaaggaatagctttagcaggaaagcagaaaatatacacctgagggtaataagactacacaagtctgtctggattagaggatttgggctgggaagtaacaggagatatgttaggaccagattatgaagccgggctaaagagcttagtttctatccctgtgaaccatataaactatgtaaaacttctgagtgagggattactgtggctacttttaccaagtttttatcttatgtgtgtatctctccaactctgttacaagtgatatgtgaattcattcttataaggaattcaccctaacctggaggtcaggggagtactttgaaatctctttgtatcttcgttatctagcacagggcttagtaggttggtgacattttaggaaaaccaaacagaaatggattgaaaaggagaaagactgggatgagaaagaccagttggggaaactgttgcttattttttaggtgtgaagtaatatgggcctgaactaggcaagtagatgtgtaaaggaaaaggaagtgatggattcaaaaggagaatgactagtagttggtgatagatattatatggaggagtgggagaagttgaaggtgatgtgagtttttgagaatatgagacaagattaatagaaatggagaagtattatagtagagagaattagtgtttgtgggaggaagatgaatttggtttataattgactgatttcaaagtgtaagtggtaaggtagatcattagaaataaaagactagaaattagggccacagaagtaagtttgggagctatgaagtaataaaattatagcatattggagctagaaaagacttcataagcatctagtccaatcacctcagaggctccaagagattcaacttgtataagttctccaaggtaaatacagtactaagcctggggtcctgttttcctggcttcctaatccagtggaaactgtaccatgctatttcctctagtgaaaatgaggttaaaaatgaatcagaggtacagagaggagcatggggtcagataggggtgaaagtaacaaagagaaatgccatcgctgtttgtgttgtacttgctctccttgggaccagaattaacttcacttggggtttcttggaaggcacgtagccattgctaccctaaaatcttgagatcttttctagctccagtattagctggcacgcttgtttctgaagttcctaaggaagattggagaccttagtttccagctatcttcacagagttgccagttaaagcagttcttatcaccatgactgttctatttgaggttctactagactatcaaggcatttttttaaaccaccaatccctatatttctgaccaagcatttgaagtataaatcataagggaattttctctttcttgcaattagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagtaagttacaatttaaagagtcaagatttttagtattagttctattaaggttaaacattagactgcttcttcaattgatttgacaaatcatcagacatcagtattgtgagcacgagtgactaatggagccattttgactgacttgaaagaaaatgagagctgacaggtcagctttgatattcagttactctcaagcttgtgtaccattctcactgtgtcttcctttcattatcacaggaatagcagctttcgctccaagctgcatcttgtagacctcgctggatcagaaagacagaagaaaaccaaggctgaaggggatcgtctaaaagagggtaagagagtaattaaggtcacagttgtagattaaaaacttctagtactcttgttggtattgttggtgttttcgactgggatttgagatcacattctaacagtagctacgattcagatttgaggctgagttcagaaatagcgaaaaattgtttctttcccttgctctcattctctaattcaggtatgagatttggatctggcctttggtttgatttcatctggtccaggcaagttttagttttagttttgttttgttttgttttaccccaactatttataattaaaatcagtatcctgattctgtcattttaagtattcaccatcccttccagatgttgtcacatataaacctcagcccaatttccatgccttcattcaagttgttgaatttgaaaagtgatgaaattcctaaggctagaagaaccctgtgatgtaggctattagaaaccttcttctaacattatagtgacctggtaatctgcatgccttggtaatgatcttgaagtgattattaatctctctaacaaaaattaacatccagctctatatctcaattttgttcttaaggatatcataaaatagttcatcagatgccttgctaaatccagatacaccatatctactgtatttctcatagctaccagcttagtaacaatacaaaaaagaaataagggattttagcctaaagtgctttttcttggtgaattcaaggttggcttctagtgcttattcttctgttttctaggttcttgcatgctgtccctctaataatccactctagacttatatcaaacccactgtttggtaatttatggaattaacttttatccctgttttgaaaattgaaattgcatctgcccagtcttctagaatgtctttctctgtgattcgtcaaagatcattgacatagcttcagcagtctcgtttgaaattactctatgttcccttagctataattcatctggtccaagatatttgaactcttattaaagcagttgggtttacacttactacctctttactcatattgggcttcatttctctcttgggaactgagaaggcagaaggaaaaatattaattgaggaattttatttctgtcatttatcattattatactgttggcactgagtgcagacctgtttcttcctcattcagctttttgttctgagtgtcattcaaagtaccctttttgttctatgtttgcacttgagatttagctttcctaagactatttttaaaggctgtaatgctttctttatcttcttttaggtgttcagttccaagttgttttatttaacagctttattgagatataatttacgtactataacattacctatttaaactgtacatatcagtggattttagtatattcacagagttgtacaatcatcatcataatctaattttagaacattttatcatcccaaggagaagccccatattcattagcagtcactccccattcccacccctttccctggccctaggcaaccacttaacttacatttctttttttttatttttttattttattttattattattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccgcagagtgtgatgttccccttcctgtgtccatgtgttctcattgtgcaattcccacctatgagtgagaacatgtggtgtttggttttttgtccttgcgatagtttactgagaatgatgatttccaatttcatccatgtccctacaaaggacatgaactcatcattttttatggctgcatagtattccatggtgtacatgtgccacattttcttaatccagtctatcattgttggacatttgggttggttccaagtctttgctattgtgaatagtgctgcaataaacatatgtgtgcatgtgtctttatagcagcatgatttatagtcctttgggtatatacccagtaatgggatggctgggtcaaatggtatttctagttttcgatccctgaggaatcgccacactgacttccacaatggttgaactagtttacatttcatataaatgtaatcatacaatatattgtcttttgtgactggcttagcctaagattttcaaggttcatccatgttgcatcatatatcagtacttcattcctttttttttttttttttttttttgagagagagagagtctcactctgttgcccaggctggagtgcagtggcatgatcttggctcactgcaacctccaccttccaggttcaggcagttctactgcctcagcctcccatagctggggttacaagcatgtgccaccatgcctggctaatttttgtattttttagtagagatggggtttcattcaccatgttggccaggctggtcttgaactcctgacctcaagtgatccacccaccttggcctcccaaagtgctgggattacaggtgtgagccaccatacccggcctcatttctttctattgctgaacaatattccattgtatggatatgccacattttggttgttcattcatcagtcatatccaattttctctgttatgaacttctgtgtgtaaattttcacgtggacaaaggttttcatttatcttgggtatatacctaggaatggaattgctaggtcatatggtaactctgtttaactttttttttaaaagaataaaagatataattatataattaacataccataacactcacccttttaaagtatacatttcactgatttttagtatgttcacaaggagttgtataaccatcaccgcaataaattttagaatattttcatcacctcaaaaagaaatccatacccattagcattcactccttatttcccctcaatatatgttcctcacctctcatcctaggcaataaccaatcctctgtctctgcagatttgcctattctgggcatttcatataaatggaattatacaatatgtggtcttttgtgactggcttctttcacatagcataatgtcaaagttcatctatattgtagcatgtatcagtactgaattctgttttattgccaaacaatcttccattgtatggaaataccatgtttttatttatccattcatcccttgatggacatttgggttgttttcattttgggttattatgaataatgctgctatgaacatttgtgtatgtttttctgtagacaagttttcatttctcttgagtgtatacctatgagtggaattgctggatcatatggtcactccatgtttaaccttttgaagaactaccatcacactgtttttcaaagcaacgacatcattttttgttctcaccagcaatatataagggttccagtatctccacattttcacttgttacttatttatttttcaaactcctgggtgccatcagatttgcttgttattatgcctttttaattatagctatcctagtgggtacgaagtggtatctcattgtggtttttatttatatttcactgatggctaatgatgttgaacatcatttcatgttatataacttttggaagaatgtcctttcatatcacatttaggctttgacccattttgagttaatttttgcatatgatgtgaagagtggtccagtttcttttgcatctgtatatgagttatcccagcatcgtttgttgaaaagactatcctttcccccattgaattgtcttggcatacttgtcaagaagcaactggtctctattcctttgatctatatgccttacgccttatgtcttcattactgtagctttgtggtaagttttgaaattgggaagtgtgagtcctccaacttcgttcttgttcaagattgtattggctattctgggcccctttcatttccatatgaacattaggttcaacttgtcaatttctgcaaaaaagccagctgggattttatagagatttcgctgaatctgtagacccacttgggaagtattgccatcttaacaatattaagtctttcaatgtatgaacatcagatgtctttctttttctttttcaaattttttcaaattttttatttttatctttattttattttattttttgagacaatctcactctgttgcccaggctggagtgcagtggtgtgatctcggctcactgcaacctctgcttcccaggttcaagctattctcctgccttagcctcccaagtaagtagctgagactacagacacatgccagcacacctggctgatttttgtatttttagtagagacgggacttcaccatgttggccaggctggtctcaaactcctaacctcaagtgatccacccgccttggccttccaaagtgctgggattacaggcatgagccaccgtgcccggcctcttttttttttttttagagacaagatcttgctctgtttcccaggttggaaagcaatggctgcagcctaaacctcccaggctcaagcaatcttcctacctcagcctcccaagtagctgggactataggcatgtaccaccactcttggttgatttttaatttttttttgtagagacgggtctcactttcttgcccaggctggtcttgaatgcctggcctcaagtgatcttcctgcctttacctcccaaagtgctggtttataggcatgagcgactgtgcttggagtatctttctttttatttaattcttttttaatattttttgataatttttttttaattttcagagtataagttttacacttcttttgttaaatttattcctaagtattttatcctttccaatgctattgtaaatgcaattgttttcttaatttcattttcaatttgtttattgagttttgtagatcttgtatctgcaaacttgcagaacttattagttctaatagctttttaaatagatgctttaggatttctgtgtacaagatcatgtcacctgtgaatagagatacttttacttctttctttctagtctggatgcctttacttctttttcttgcctgcttgtcctgactagaagcgccagtataatggtgaataaaagtggtgagaatgaatgttgttattttgttcctgatcttaagggaaaagcattcagtctttgttcttcataggtgccctaccaggttgaggaagttcccttgtacacctagtttgttaagtgtttttatcatgaatgggtatttgtcaaatgcttttttgtcatctattgatgtgatcacatgatcacattatttttgttctttagtctattgatatggtatactgcattaattgatttttgaatgttaaaccaaccttgtattcctaggataaatctcacttgtttttgtttgtttagtgactttcctggactgattctgtaaactggattccctgtagtttgccatcacagaagtgtcttctctgttaatttagtggttacttgatgactggtctcagttacttaaatgccttgaacctatacatcttccaccatttgccaagagttttgtgtctgtgtttgggcatatgccttcaacactcaggcacttttacaactctgccttagccttcactgcttaaacagagtctcaaagtcagccagagatgcaaaatttatggctttttaggtctttcctgagcatgtagacagccctatacattcagacaactttctagaccttcagaaatatatctgaactttttaatccccactccctcccgtggatacctcatttcccagaccttttaagctcttagctaggcttttgtttaaccatgattattaagtttggtgtttatctttaccagatgtttttctgtgcatatgtgtatgtgtgcatatagtaatatagtttttatatacctttaaatattttggcattgcctaatttatttatttccttttaactatacaagtaatacatgaatagattctcatataaaaatacaaacaatacagatgaagataaaatctaccttgatttaccacccagtcctaatccagaggtgaacactttcatctgactggtgggtatcattcaagattttttcacgtacacatatattttttattggtgttgctgtgtttttaaagataaatgtcatcatgctacacatattgtttttcaacttgcttttatctcttcgtgatacaacttagattttttgttttgttttgttttaagagatggagtcttgctctgtcatccaggctggagtacagtggcacgatctcggctcactgcaacctccgcctcctgggttcaagtaattctcctgcctcagcctcctaagtaggtgggactacaggcacatgctgccatgcatgactaattttttgtattttagtagagatggggtttcaccttgttgcccaggctggtctcgaactcctgagctcaagcaatctgcctgcctcggcctcccaaagtgctaggattacaggcgtgagccaccacgccaggcctgagatcttttttgtatcccgtgtatataagtctacttcatttaaaaaactgttacataggattccacggtatacagtctaccttgtttattcctattttggttgacatttcagttttccaatttctggctattggaaattgatgcctcactagatagccttgtacatgataaacatgtgagagtattctctgttatgtacctgaaagaggaattgctagattgaagggtatacacgtttgagtaaatactattaaatattgcacaccaaaatgtctgcctctttatccactctacctacaaaatatgatgatgtttctctatactactgacaatattggatattattgacctttttagtcttgcctctcttgaatattgcatgttattggctatttctctttccatttctatgaattgcctgttcataccatttgcttattttttcttctttcatgttgtatttttcttattgatttataggagttgtttatatattctggatattaagccttagttacatatattgcatatgttttcctcagtctcattttttaactttattgatctttttcatttgtgccttgtgtgtgtttttcttcttacatattttttctatttttgaatatgtaaaattggctacttaaggagcaatagctttttttctttttcagccttattgaggtataatagacaaaaaaaattgtaaatgtttaaagtagacagtgcgatactttgatatatgcataaattgtgaaatgattaccacagtcaagctaattagcatatcaatcacctcatgtagttatatttttcaatatgttatttcttgaagtaaaatttatatacaattggcctggcacagtgactcatgcctgtaatcccaacacttggggaggtcgagaagggcagatcacttgaggccaggagtttgagaccagtctggccaacatggcaaaccctgtgtctactaacattccaaaaattagccaagcgtggtggcgcacgcctgtagtcccagctactctggtggctgaggcacgagatttgcttgaacctgcaaggtggaggttgcagtgagccaagatcacgccactgcactccaggctgggtgacagagtgagactctttctcaaaagcaaacaaaaaaaatttatatacagtaaaatgcgcataccttaaatgcttagtttgttgagttttgctagttatatacattcatatatctaccaccaaaaatatcatataaaacaattccatctttccagaaacttcccttgtgcccctttccagtcaatccatccttcccccattccacttccagcaaccactttctgacttctgtcaccatagattaattttgcatgttcttagacttcattacagtgggatctcaaaatggttgtgtgtgtgtgtgtgtgtgtgtgtgtgtgtgtgtgtgcctggattcttttgctcaacatagtgttttttgagatttgttcatgttcttgctttgattagtgattttcctttgtattgctgagtagtattcaattctatgattataccactatttgtttttctattctcgtattgttgagaatttaggttatctcaaatttttagctattatgaataaagctaccctgaacatttgtatacaggtctttttgtgaacatatgtttccatttcacttggataaatacctaggaatagaagagggcaagcgtatgtttaactttatgagaaagtgcctaacagttctctaacatggtttgtatcattttacaccccagcagtgtatgagagttccagttttttacgtttttttgtatgctctggtacagttgatataacatggaaattatctctgaaggtttcttgaagatttgattttctatatcttgagccaattctggtcatttatattttcttagaaaattgttcattttggccagtcacagaggctcacacctataatctcagcattttgggaggcctaggtaggaggatcgcttgagcccgggagttggagaccagcctgagcaatatagtaagatcactgtctctacaaaaaataaaaaattagccaggcatggtggcacatgcctgtagtcctggctactcgggggactgaggtggaggatcgattgagccctgaagaccaaggctgtagtgagccaagatcgcaccacagcactccagcctgggtgacagagtgagaccctgtcctaaaaaaaaaaaagaagaagaagaagaaaaagaaagaaaattattcattttttctgattgccgaatttattaatataatattgcaaatagatttactttatagttttaatctcctctttatctgtagttatgtctcactttcatttcaattgtttatatatcttctgttttttctatcacatttgacagattaactctacctttttccaatttttactattactctattactgagttcttcctaagttgttttattttgttttatgttctttttattgcttcttgagttgaaagctgagtttacttcttttcttctcctttttaaaaaagcttttcaagcatatacagaagaggtcaggatggtataatgaatgcctcccccaatatacctgtcatgaagtttcagcaatgactaatttatgaccagtcttgttttgtctatataatacccactttctccctctgatattatttgaaacaaatcacggacatattgttttatttttttcagtttgtatctgtagaaattaagaactcttaaaatataatcacctaggtcaggttcagtgactcatgcctgtaatttcagcactttgggaggtcaaagcaggaagattgcttgagaccaggaatttgacagcagcctgagcaacatagcgagaccccaccatctctacaaaaataaaaaataaaatagccaggtgtggtggcatatacctgtagtcctagctgaggcaggaggatggctggagcccaggagtttgagactgtggtgagctgtgattgagccactgcactccagcctaggccatagagtgggaccgtctctaaaaaaaaaaaaagaaaaaaaaatatatatatacacctaaaaattaaattaacaataatactaatgccttaaaattacatatctagtcagtgttcaaatttttaattgtcttatagattttatttatttggatcaggatacaaacaaggtccacacattgttattgctcaataggccttttaaatgtcttttttttttttttttttttttaagacggagtgtcactctgttgcccaggctggagtgcagtggcatgatcttggctaactgcagcctctgcctcccagattcaagtgattttcctgcctcagcctcccaagtagctgggattacaggcacacgccaccacgtccagctaatttttgcatttttagtagagatggggtttcaccatgttggccaggctgatcttgaactcctgatctcaggtgatttgaccacctcaacctcccaaagtgctgggattacaggcatgagccactgcacccagccaaggcctaaatgtcctttaatctctaggtacctcctccatctttctttacccctcaagtccctggaatttgtttattgaagaaatcaagttgtcttgtagaatttcccatagtgtgaattttgccaattgcatgcctatatagtttcacatgtttcacttttattctctatttcctataaattggtaattcgatctagaggcttaatcacattcaagatcaatttttttcttttatttgcacatacataactatgtctcatttattttcagttgttcttatctaaaaagatatatttaaagctatacatctcctctaactaccacttcaatctaatcttataattttgagaaatagtactcttattgttcatgtctaaataggatatttactctttcattttctctcaaacctaaaagttatttagaaggtgcttctgtctttccttttattgtcaatttctaatgtattgcattatgttcaacaaatgtatgtgatttgtgttttttgaaatttggcctatacttatttggtctttattaatattctgtttatatttttaaaaagtgtattttctcttgggtgtatagttctatatatacctattagatgagcttgttacttgtattattcagatcctcatgttctttttttttacttaatatgttattttctcacagtatgaccaagaatttgtccatttctccttgtatttcttagtttatacattttatactttggagctatgttgccaactgcataaaatgtcatgacatacgtcttcttagaggattatatctattttgtctaattagtatttcttcacctactttctctttgttagcccttacctggtatgttttccatccctatcttacagaaactttgtagcttgacttcattaattaatttatccattcatttatacccaatctgatggtctctctttttaatttttttttcttttattaaactgcttagggatgatgttctcttttaacaggtagttttaccctctgtattcgtgtgtgtgtttggacttatttctgtcatatcactgactattagtctatggtcctactcctgctcctgtaccacaaccagataccttgaccattgtcccagggcttccttctgttttccgaatccactaccttcaagtctgtagtactcctgcagttgctgccaactttttatatcagttctctcctgcatattttttcttatgttggtctgattcatctgctttcagtctctcaaggattttgtggtttctgatccaccagtgatggattcacaggaagttggtggctttcccacttggcagcctattcaaagacttttaggggctctaaaggaattttactcaattgcattagagggttttacatacacattctgggttgcccatcttagcttcagagcttcaatttcctcatttgtaaaataggatttgaatatattctccaatagagttgtgggaattaagtgaactcatattcgtaaaacatttaatgcaattcttagtaaatagtagtctcttcataattaccaattccatcatctgtgtttttacttgctctgagtgtggctaatgaggaatataggggctctactgatatttatatacaatctcagctgaactaagatccctatgagcttgctaaggtgcttgtcaacatttgaggtagatttcgagggtggaagaaacttttagggatatggcttatacctgtggaattaacttttctttggctaccaaactgccattgtcaaaggcaagtcctccactgttagagggaatcattttctacttatcaagaactaagaaagttgctaaaccctctggaatattttcagaaggtggatatggcccggcagaatattgttacatgttgcattactgtggattgggggaaaggagatgtacccaagtgtcagatttgactcgtgaggcaaagaagtttatgacagaatcatagttgagtcctacatcaagtggcagatgccaagagttgaagggaagctagtgagaaaacaggagataggtatataggaagcagacagcagatggaaagattttggacatgtcagatttggagtacatattagaaaaatccaggaagaaatcagaaagtcaggacaagagcttagaagcaacatctgggctagagataaatatttggaatccatgggtaggagagttgtgcagagaaagactggacaatcaaagagccactagtaaatattaaataatattagtaaatactaaatatgagcgaggggcactcatatttaagggccaagggtaaatgagtcaataagagaagctgaagagacactggaggatcatagtatctagataaccaagggtttttataaacaaaaaggactgtcacctgtgtcatatgcttcagtgtgattactgagaagaggtaaatagatttgtccgttgaggttttgggtgatctttgtcagagcagtgtcggtcgagtggtaaggaattaggacaggttgtatcaaactaaggggtgaatttagccaccattctaaatgtggtgtttatcctttccattaatttctttattcttatatcctttaatgatatgtagtgacattttgcatgtttctaaacttaatgtaaggggtttcatggtatatgtgtcttctgaaactgattttttccctcaacattatgttcttgagatcaattcatcttgataatatagctctgttctaacaggttttgttaactagaggcttgagttttcttggtatcaaattgtatcagtaagaagaaagttacctctgccaatatttattcctttatttaattctcttatgtttcttagcaatgagaaaaatgtcagcagatataccctggactagtaaagttgctttcctcaggggaatctagtttctgatttaaatcagaatggttttaatgttttattatttggaatgataattgctattggtgttggtaaatggtatttaattctcttagttctaaagtcttttttaagtgcaaattgtctgtttcattcagcaactctattcattaaagtcctgttctaagtgttctgcatgttctttttggcttctgggtccctttaggtgtattgttattttccttggtctgctctctgggactgaagtctaatgctggagtatctgaagtcatagcagcccagtgagtgggaaaagcacagtggtttctgcccatgagctagcaggcgtattgccagtcagcttgtcaaacccatgaggaggcatcaggaggaggcctctctgtactcttgtttccttgtgctttcttagtctcaaggtagagaggacccaacccatctcattgttttcttagcattttcagatggggaaacctggcacactcacataagcagtattgactttccccctaggagttcagagtggtatgggcgaagcctttgccacagaccatgtttccatccttgcactttggctctgctacaccacactcttagcccagggcttttctctgttccagagatgaaaaattctacatcaccccttactctcaggtctcagacccatcctgcaacctacttttttggctggccccagcacctacttggcttaagaacagtcaatgaatcaggtttgggaatagaggcgatttggaatattttcaacttactatcttcccaaaattcatgtaccttttaaaaatagatgctaccaaactcccatgaaggaatgatgagattattcattttcctaaattctctactaagtattattaccaatttgataagtgaaaaatggcatgtcactttcatttctgtagttattagtgaagttgaacatacttttatatttataggccatttatattcctgattaaattacctattcaaagtatttctctttagtcagtgtgagtgctgtacattttctgttaagtttatccctactttttgttgtgattttgaatataaaacatatttaggccactgccagatagattataaatagattacagatggataataggtagattattcaattgaagtataatatacatattacacataaatatatattacatatacatattatgcatatatgtatattgcatatacatatatgtgtattacatacatattatgtaatataatgatatcaagtcatcattatacagttcaacgaatgttcacaatatgaaatacatacatgtaaatagcacccaggtgaagaaacaatattctaagcatcccagaagtgtcacttgtgctctcttctagtcactgtcttccccaaagagtaaccactgtccagacttttagtcctagattagttttgtagtatggactccttcatgtctgacttctttcactcaatgtaagatctccagagaaaatacaagatgcctagataaatttgaatttcagataaatgacatcattttgtatggaatatacctatattagaaatgattcatcatctatctgaaattcagatttaactggatgttctatattttttttcttttaccaaatctgataaccctaactcaacattatgcttgtgaggttcatccatagtattgcatgtagttgtagtttgtttatttttcattacaatatagtattccactgatgaatgtaccacaatttatcctctttactgttggatgggcatttgggtaatttccagtttggagttgctttgaataatgctatgaatattcttgtacaggtattttggtgaatatacgtacctaaattcctttaatcctgaatcctcctgtaactactgtcctatctccttccctttagactcaagcttctcaaaaaagcttacactgcttagcaatacatgtgattaactcttagtttcacttctttggtgagacatagcatacatacagaacattgcataagttatgtcatgtatctagtttaataaatgattataaagtaagcatctatataactaccactcaggttgaaaacaaaacacttccagcacccatgcatacccctccgagatcatgatccccttccttctctctccaggtatccattcttctgacttttgtgatgtcaattcccttgcctttttttttttttttttttgagacagggtctcgctctgttgcccaggctgagtgcagtggcacaatcacagctcactacagcctcaacctcctggactcaagcaatcctccctccttagcctcctgagtagctgggaccacaggcacatgccacaattcccagctaatttttaattttttctagagttgggatctccctatgttgcccaggttggtctttaattcctgggctcaagcagtcctcctgccttagcctcccaaagtgttggaattacaggcgtaagccaccacacctggccccccttgcttgcttgcttttcttttctttctttctttcttttttttttttttgagatggagtctcactccattgcccaggctggagtgcagtggcgtgatgttgggtcactgcaacctctgcctcctgggttcaagtgattctcctgcctcagcctcccaagtagctgggtttacaggcatgtgccaccacacccagctaatttttctatttttagtagcgatggggtttcaccatgttgaccaggctggtcttgaactcctgacctcaggtgatctgcctgcctcggcctcccaaagtgcagggattaccggcatacaccaccatgcccggcctccccttgctttcttgatagcaatgccacctgtgtatatatctctaaatagcataatatagttttgtctacttttaagctttatgtaagtggaattatactgtttataatctgttgtgccttcattcttccatttaaaatgatatttgagagattcatctactacattacatacagctgtagttcatttcttttcatttttgtatagtaatctatcatttgtctgtaccactattctttctacttttgatggatattccatttttttccagtttttggctattgtcaacaacgcccatatgaaccttcttgtttgtgtatcccaatgcatatgtataagaattttctaggatatgtacctagaagtagtatcactgggttatagagtacatatataccaaactatctttcaaagtttgtttcaatgtatgagagtcctaattgctctatatccactgttttgtgagaattttaaatttttgccaatatagtagatgtggagtgatactttattatggttttaagtttcatttcctcaattactaatggggttgatcaccttttcatatgtttatcgaccatgtgtattttcagttaaatgcctgttcacgtcttgctcatttttctattaaatgtctttttcctactgattaaaagtaattcttaatatactatagattctagttattggtcagttatatttattgcaaatctccccaccctgtgtgttttgcacatatcttctccctcctctctggcttgtgtttttactttctttttaattttgtgtcttaagaaatcctttaggccgggtgtggtggctcgcgcctgtaatcccagcactttgggagggcgaagcaggcggatcacaaggtcaggagatggagaccctcctggccaacacggtgaaaccccgtctctactaaaaatacaaaaattagtctggcgtggtggcgggcgcctgtagtcccagctactcgggaggctgaggcaggagaatcacttgaacccgggaggcagaggttgcattgagccgggattgcaccactgcattccagcctgggcaacagggcgggactccgtctcaaaaaaaagaaagaaagaaagaaatcctttagtacctcaagatcttaacgatattttttctatattatctaataaaggctttacagttttgcctttcacacttaagcctttaatccacctagaactgttttttttatacatgatatgatgcagggtccagttttgtttttccatataaatacccatttgtcctagtactgcttattaaaaagtccgttctttccctactgataagcagtgccatttctttcatatattaagtgcccaaatatcccttagtctgtttctgagtattctattaaatcaaaattaaatctgagtgtttttccctgtagaagtcttatacatcttttgtactattcttacgtaacttgtattttgacagtattgcaagtgatatttttaaaactttttattgaagtataatgtggaaatagaaaagtagacctaccataaatgtatagcttgctgcattttcactaactgaacaaacccatgtaaccaacataaatagaatctttaaaaattatattttctaactttgttttttgtgtgtggaaaataaaatgtgttctttaatattgattttgtatcctgcaacctcattcactctctcagcagtctgtctttacccaccttgccaaaaccactatgtaagagatatccagggatatcttaattaccagaactaattttttttcagtgcccatcttacccaacctctctgtggcattaacacttgaaaatactctttttgaaactcttaatttggcttgtaaagcctcactgtcctagttcttttcctagctcaaactgttacttttcaatcacttttgctttttcttcttgctgatccattaatctaattgcacccagcatgatctccccaattaggaatgagtacccattacctgctgttagttcttccttagcaccatggtagagatgcacccacttccagtctgttcctgccacctctacaaagtccatgccctcacctgcacatctgaactgtagccttctaactttttgactcctagaaggcattctattctaaataccatagctaggttaatcttaaaataccctttgatcaaagggatacatgtaccgctatgtttattgcagcattattcacaatagcaaaaatttggaatcaacctaagtgttcaacagatgaatggataaagaaaatgtggcatatatacacagtggaatactattgggccataaaaaagaatgaaatcctgtcatttgcagcaacatagatggatatggaggccattatgttaagtgaaataagccaggcacaaaaagacaaatattgcatattctcattcatatgtgggagctaaaaacaagggtataatggacatagagagtagaatgatagttaccagaggccaagaagggtgtgggagtggaggccgaggggaagaagagagaggttgattaatgggtataaacatacagttagatggaataagttctaatgtttgatagcagagtagggtgatgagtgaacagcattgtactatacatttcaaaataactagaagggaggaattgaaatgttcccaacacatagaaattataagtgctcaaggtgatggatgccctaaataccctgacttgatcattacaatttctatgcatgtaacaaaatatcacctatatccataaatatgtacaaatattgtgtatcaataaaaatacataaataaatgaattacatatgtagctttaaaaataccaccttttacatggcatctcacgtaaatagaactttgaagtagctgcttacaagatgaagtctaaaaaacatagccaaatcttccagaccctttataccctggtcccaagcctacctcctcgaccatctttcacagcttccctacccacactccatgccagctgtcaggtccccacaacatgcccagctaattctggtctttgcacactttcatcacagccatctcctcttctcccagaatgtagtgtgtgccccccaacacacaatcaaaccatctacaacatagccacgttttaagactcaacttaagtgttggggttttcgacattgccttttttaatcatgttatcttctaatgtatttttttctcctctgagatttctctagtaccacaggactacattgtcattttctggtgcctctgtatttctagcttcatctcccaccattttcccacaaactacaaggttccagccatagcagtctactcattgtttttccaaacagttctgttgtttcagatctctgtgccattactcctgtgtgttttctgctggattttctccccactgcctcagaaacatggttctgtcaagtactcctgctcctcctgttttaacttctccctctcaactgactttctgccctcagcatagaagcatactaatatttccccaacttaaaataaacaaaatatttcatcctcctcttactactgctctcctcccttttcctttcattctacatttttgtcacccctccatcctcctcccattgaaactatcccttttgaagtcaactcatgacctgaacaactgaatccattaggctcttttcagtcctccactgacttggtaattctgcaggtctgacatcctgccccttcttctggacaatctcattcctcttgactctgtgatgctaccctctcctgattttcctctcacttttctgaagactctttcacaggcttctcctcttccactcacccctatctgaaacataacccaggctttgtcctgggatattttctttctcttcccactgttcatgcccatcaccctgtcaccctccccccccaaagtggtttcacccacttagatgcttataattcctacctgtatgctgccaatcctaaacctctatctcgagcccctatctcataagtcatatttaagtatgtaaatatagttgactgtggggagtcttatggatgtcccacatgtatctcccattccacatgtccaaaactgagcccctcattcctccctgttgctgttttttttaatttattttatttatttatttatttttgagacagagtctcactctgtcgcccaggctgaagtgcagtggcgcaatctcggctcattgcaagctctgcctcccgggttcacaccattctcctgcctcagcctcctgagtacctgggactacaggcgcccaccaccacgcccggctaattttttgtatttttagtagagatggggtttcaccgtgttagccaggatgatctcgatctcctgacctcgtgatccacccacctcggcctcccaaagtgctgggattacaggcgtgagccaccgtgactggctccctgttgctttaaatgggtccctccatcaccggcagtgaataatatcaatatccacccagtcacccaagacagaaaccagggcattgttctatgctcttttttttttttttttaatctggctcctttccccaatctcattagtcactgagacctgtcagtcctaacttttcatcttttacttcactctcttttctctaaccctactaccactatcttatgtcaggccctcatcatttttttgattatagcaagaactggtctccctgtcttcagttaggtaccctttcaagccattaaccaatcagcagccagagtattcttcctaaactgtttctcgctgctaagagctcttccagagctcctcagtttgcaccatgctgcctccttaaggcctttttgctctagccatccctccctggctagcttttcctctccccactctttccttgcaatctgcttagccatactgagtgtgcctcgtactctctcatctatgtgtctttctgcattctgttctctctgcgaaattgccttccctctatcttcatgtggctcattcaaatttgcgctcagtcccaacttcatccccttaaagaaactttgtttgaccatctcacttcccccaaagcggattaggtacccctcatctagtgcttacctgtcttccacactaacactgccccagccgtgtattacagtcatttccttaactacctgactcccccagtagacagcaagccaatcaaaggcaagaactgggtcatattcctctttgaatccctaggccccagcatagcacctgacatgccataggtcctcactgaatgcctgagttctttctcccttttggtctgcctggcaactcctactaatatttcaattcacaattcatatgttacccacctatgaaacctctgctcttggtcaagatctttccataaattcatgctcacatagtgggttttctctaacatttattgataaaaattttcaaagttacttcaagttgaaagattttacaatacccctatacctatagtaaaattaacattttactatatttgctttatcacaaatctgtccatctatccatttgtcagtctatatccattttaaaaacacatttttaagtaaattgcacaaattaatatacttcctcctaactacttcagcttacatatcattaactggcatttaatatttatttatttatttatttatttatttatttatttatttgagaccgagtcttgctttgtcgcccaggctggagtgcagtggcgcaatcttgactcactgcaacctccacctaccgggttcaggcgattctcctgcctcccaagtagctgggacttcagatgtgcaccatcacgcctggctaatttttgtatttttagtagagacagggtctcaccatgttgaccaggctggttttgaactcctgacctcaggtgatctgcctcggcctcccagagtcctgggattacaggcatgagccaccatacccgaccaatatttatattcttaatataagatgtacaatgaaaagcacaaattttaagtgtgtattagctgggttttgacaaatgcatttacccaaaagcctgtaacccaaagcctcatcaagataaagttacctctttgtcatagtgttctttcttttcttgtaattatttaattatctgtttcccccattagactttgagttccttaaaagcagagaccatttcttattttcctgctacctgtgccccgcactgtgccttaacacaataggtattctataactgttgtctggctagaagaataaatatgtactttattcctggaatattagtatgcgactttatacattctcttctctcacctttcacatccagaagttagcttagtcatgtcatgtttatgccttaagtacttctgacttctacatccttcattccttttccactgctgcagttctcagagatctgtcatctgaaccattaaaataaccttctaaatggtttctttctttttttcaaagttttaaactttttatttgcacattttaaaaattatgcattctagtaaataaaatcatttgaaaaaaaaaagaatggtaaagggttttttaaacaccaattttttactcccaagtccaccttccaaatgagtaacaaagtaatacttatatttatttttcttgagacagggtctcactctgtcgcctaggctggagtgcagtggtgtgatcacggctcactgcagcctcaacctcctgggctgaagccatcctcgcacctcagcctcccgagtaactggaactgcgagtgtatgccactgtccccagcaaatttttgtattttctgtagagacagggttttgcagtgttgcccaggctggtcgtgaactcctggacaaagtaatacttataaaatccgaagttggtcatgtttccatcctctttaaaaccttttatttgtttcccattgtctacaacagattttaatctgccttcttttaaaagcataggagctttttaaaaaataaaaccttacaacaaattctaacatttgaaatagatttaaaaacattttaaattcatgtaaatttataagttcaaatgtataacattaagtcaatattaaagccataagaatattataggtatgtttatgagcacaatttctttgtttttttcttaagacaaaatctcactgtcacccaagctggagtgcagtggcacaatcttggctcactgcagccttgacctcccaggttcaagtgattctcccaccccagcttcctgagtagctgggactacaggtgcacaccaccacgcccagctaatttttgtattttaggtagaggtaggattttgccacgttgcccacactggtctagaactcctgggctcaagcaatccacccgcttcggccccccaaagtgctggcattacagacatgagccaccatgcctggccattattattcttttttttaatttcaatagtttcagggtataggtggtttttggttacatagataagttctttagtggtgatttctgagattgtagtgtgcccgtcacctgaggagtgtatactgtacccaatatgtagtcttttttccctcacccccatcaaacctccccctggcctgagtccccaaagtccattatgtcattcttatggctctgtgtccttgtagattatccaagtttttctactccattaataataacttaaatatagatagccctttacaaatcacatttgatttttatcccagtcccattaggtaagatcggtattttccctgttttatggataaaagaaagtttcagtggctagttcaatattatacacattggtgaatggcagaggcagaattttaactaagattctctctctcctaatgaagtgcctttcctactctatcccctatcgctggttgcctctatatgttttgtgatccatttcagtaacaatcattccctttctctttgaccaggcagaccatctatcataccatacttctgtttttcaccctaatttactcagccattctacctgctttaggcccatacatattttcttcacacgtagagcagggtttcccagctgtggcaccgttaatattttggatcaaataattgtttacggggaaggaggctgtcctatgcattgtaggatgttttacaacatctttggcctttacccgatgaatgccagtggcacacataccccactcctaagttgtgacaaccagaatgtctccagatattgccaaatgtcccctatgaagcagaattgcccctagttgagaaccactgcatatagatctacatttctctcctacctcatttttcttttttcttacaaatatgcttttatattccagctgtaaaacccattgtaatgtgcctccatgatagctgtgaagttatatttctcttttaaagttaaaatctctcctttattatttatttgttgccatagtgaacaaacacccaaaggtattgagtagcatttttgactctccttacttgatctgttctcattcttacagagaaaactacttcatttttcttcatagctgtccttaatcagaacttttaagtctctgcaaatatgttcttccccatctttgtgatatatattccatctttgggaatcatttatcattttaatgtcttaacaggaaatcaaatcctgttttgtggtgatttatttcaagagaaacattcatgtctcttatctcctttctattcttgagccccaactctcatttgaagaagaagaaaaaaaatgcccactttatccttaagtctatggttcttgcttggatcattgccatagattcttctcagggtttgtctggaattttgttttgctcctatatgaaactatagatggaagttttgctcagcagctttgaaaaacctcagcagtctctcctttacatctagttgagatatgggccaataaaatagcacaatgttttgtttggctaaaaagagaaggaaaagacaggaatggactaacataggatttagtacaggtattagcaggcaggtttgataaatctcagcaggctttccttcatatcctagagaggataagcagtacccattccagttggtaataagaggaaaacaaagggataattgagaaaattatttttgttttagattagggagatttgagcgtgggtgtaggctgaaaagaaggaaatagtgaaggaaaaaaataagtggaagatctaagagagagggagaagctaaaggatcagggtcccagaggaaatggaaggaatagaaacagaggcagaaggcaggaccttgaaaacaaaggcagctatttcctctgaaacaaggggaaggatgaaggaataagtaatagcaaaagaatgaatgtgaggtgaggagaggggaggttggggagcccttgtggataactttcatctctataaagtatttggtgaaatcatctaccaatagaaagtgaagataggtttatattcttaaaaatgatgagtctgtataatagctgccatggtgaattagattagttagattagaaggttagtaaagtaggaatgaggaagaaaagatgatcaattgaccaagggttcagctaaggttaggtagcatgtttatagtggatctcatctgtttggttatgctgtttcttcagtattgtagcctacaaataaacatacacgcacacagttggtttaacctatggttgagaattgacatggtgagaatggtagaagatcatatgtccagtgagttcttaggaaaacgtaattgaaattttcaaccatagggttcagagtaagagttgaaggtccagaagaggctgatctactgacagtattagaaagtgtcagtaaattggtagtccaaaaaaagggtgaagaacaggatccaaagaaatggaaggatagtaggatgcagtcaggaatttcgagttcaggatctcataaatataattgtttcatgttcaaaagatggctatataaaaggtagagtagagctaacaataatgataccatttgtgctgctataacaaaataccttagactgggtaatttagaaacaatataaatttatttcttacagttctggagactgagaagtccagggtcatggtgccagtagaatcaatgactggtgaggacagacatcctggcagcctcacatggcagatggggaaaagggataaacggtgtgtccccacatggcagaaggggcagaagggcaaaagcaactagctaattctctccagtcctcttatcaggcaccaatcccatccatgaaggtagacatttcatggcctaatgatctcctaaacgtcccacctcctaatactattgcattgggggctaagtttcaaacgtgaattttggaggagacgcaaacatttaaactatagcatgatttatttatcatttaactttgcttcatatatagtatcttaattaattccctaccacaacccaataaggtaggtagatttgcctcattttataaaggaacttaacccaagatcatataactagtcagtgacagagccaggattgtaagctgtctattttaacaccaactatgcacttaaccattatactatatagcttttccacagtaagcctaataatgggaagttaattgcttcagcagaacttcagaggttattacagtgtttaagaagtaaacctcagaattaaccaaagtggaaaataatctttatcttttttaaagctacagtaggaaaggtatttcactatggtataatgaaaagagcataggacttgactaaaatcttgagatagaatctcaggcctaccatttactagctgtttgaccttaggcaggtcatttaacctctgagcttctttctttatctgtaaaatgagaatgataataaaaataatgatgatgatatggtaaaaaaaaacctgttcatccaatttcacagcattaatttaaagattatcataatggatataaaaagtaaataactatacagatggttgtcatggtgatagttatttatctatctgctttgtttccatgggaaagggcaagaagtgccagtggactcaatcatacatatccaacatttggacctttgtcctttacttaaagaggcactccaaaaagtgaacaagattaagaagttttctcaagattgatgactcgatatttttatggggtctttatttcttttctctttctcagaagaaacataggtatatgttggatgcattaccaagcaatttaaatttcatttcctgctattaggtattaatattaaccgaggcctcctatgcttgggaaatgtaatcagtgctcttggagatgacaaaaagggtggctttgtgccctacagagattccaagttgactcgactgcttcaaggtaagcccaaagtgcctccaaaaataagagagtaactcaaaatgatagtgctgagacagcaaagatgaaataggtaaaaagccagctatttggactatgacatacacagttgtctaattgataaatacgagagagtgctgttggcaagcaggtttctaagataatggaaaaatatcttcatatatgacattgagagccaagaaatctgtagtgcaccaactgtactttgtactttacacctgaaagtgaatttggttactgtttctttaattattagtgcggctaagcagaattccctggagagttaaaatccacctagagggggcatcctaagaatgtttaattccactagtggctcctaacttacttaggccaggccccagttgttttaacctgattaactgctgaaatcacaatcccttttgagaaaggggacacatgcaataggatttaaatgtatattacatcagaaatcttagatatgtatacatttcctattatttcaatataaaaaacactaagaactttttcttatagctctgaattttaagtcaccaacccgaatggacggctttgcttatatcctacttgtttgatttcatttcctttcgttattctttattgttctttttcagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtataagggacttaaagtttgatgggaaaaattacaagtatgtgagtggaatgatagagcttctgttttcagtttcttctttatcagaagtttagagatgttggttaggcattatgtttgttcggggacctcttaaaataactcctattaacgtgtttgctgtccatttaagattgggggtagcattggaaagttcactgatgaagaagtgagcagtgagagatgagatgagaggtgtagacaggggctaaattctgaagttccttatatgacttgttaaagaatttggaattcaacctgaaagctatgaagagccattgaagagttttaagtaggagggtgatatgataaaatgtgtgttttggcgagatcattctagcaggtatagagaaaatagattagaagtgggcatgactagaagaaggaaaataaatcactgcacaaaacaaagagagttctagagagaagaaacataggtagcaaagtacagttgattctcgaacaataggagtttggtccaacaaaacacagatcaaaaatacagtatttgcaggatgagaaacccatgtgtagactttttatacatgtggattctgcagggctgaccgcaggactggactatgcatctacatttttgtatacgcacagggtcctggaaccaatcccctgcatatacataggaacagctgtatagtggccaggagcactgacactgcaattagcccacccatgttcaaatcttagctctataactcactggctatgtaccttgggcaagttctctgtgccttggtatccctatctgtacagtagaaataataataataccttcttcttagggtttttgtgagggttaaatgagttaatacatgtaaagcacttagaacagtacttggcttatagcaagtgttggaagggtctgagataggacagaagtatagtgcatttgaagaactcaaagaatgccagtgtggctagagtgtagaaagcaaggaaagagtacaggcttaccttagggatgttgcaggcttggttccagaccaccacagtaaagcaaatatcgcaataaagtgagtcacacaattttttttgttttccagtgcatagaaagttatatttacactatactgtagtatattaaatgtgcaataccattatgtcttaaaacaatgtacataccttaatttaaaaatactttattgctaaaaaaaaatgttgacacagagacatgaaatgagcatatgatgttggaaaaatggtgccaatagccttgcttaatgcagggttgccacagatcttcaatttgtaaaaaaaaaaccacagtatctgtgaggtgcagtaaagtgaagcacaataaactgagatgtgcctgtattccaggatgaggctagagggaaagcagaggactgatccaggactcatggacaatattaaaaaggattttaagccaggtagtaacttgataatttacatttttaaacaatggcctggctgctgtatagaaatggattatagtagagcaagagtagattcatggagaccatttaagaaggtactgcagtagtctaagcgagagataatgatggcttggacttagagtgctggcagtggtgatagaaagaagtaaccaatgaattagataaaggaatgacacccagatttctggcatgtggaactggatattcactgacctgggttacactggaaaaggaccaggtttgaggataccagacaactaagtggaaatatcaggtagatagttgaatataaaagtataaagttcagaaagatctgtgcttgaggtaaatttggaagtcaccagtttcaggtaatagaaaccagaggcagagatgagacattcagaagagaatataaggagaatgtaagtaagaaaactcctactgagctttgggggactttaccatttaaaggacaagtggagcaaagatgaaccaagaaagagacttagaagatcagttagaagaatagaaggaaaagcaggaaaatgtgtcttgtaagccaaatgctaccagtcagtcagtcaagtaaaatgaagactggaaaatgctcactggatttggtgacatgcagctcgtttgtaacttgggcaagttatttcattggaacaatgtaggcagtcatattggagtaagttgaggagcaaccgagtggcgagcgaaaggaaatggaggcaattggtgtattattctctcaaactttgtgaaaaaagagaaaaatagggcaagagagataggaagtggggttggggaggatgcttttgtttttaagatgggagagacttgaacatattttaatctgaataggaaggatcttatagaaagggagaaattgaaaatatagaagagagaagggataacagtgtaagattcataagatggcaagaagagtgggaatccaaagcacatgcaaggagaccagtcttgggaggcagaacagctccccttgtgtcataggagggaatgggagaggatgcttacacttgcgctctggtttaagatccatctccatgaagcctccctttgactatttaggtttttgttaatttgcttattctgtcttgtattatttcctactattttagacttcaggcttatctttcttaagtagattgtaaacttgagagtaggggtcatattttatttttatatgtccgtacgttgtctagcccagtgctgagactgattttcaaaaataggtactcaaggccaggagcagtggcttacatgtgtaagccccgcactttgggaggacgaggtaggtggatcaattgaggtcagcaattcaagaccaggctggccaacatggtgaaaccctgtctctacaaaaaatacaaaaattagctgggtgtgttggcgggcgcctgtagtcccagctacttgggaggctgaggcaggagaatcacttgaacctgggaggcagaagtgccactgcactccaccctgggcgacagagcaagactctgtctccaaaaaaaaaaaaaagaaaagaaaagaaaaaagaaaaataggtgctcagtaaaaactcattaagatgtagataaaatggacaactcatcttctacttaatagttgttcatgtaatgctgattttcctgttatcattggatcatcaactatgtatgatgcctttggtagtatctaaggtatgctatctgccttagatttcatagacatttagtaaaattactttattgctaattgtggtaattttactgccaagggttaagtagcatttggttggtgactagctgattatttttctttgcttctcccaggtacaacagctacaagtcttgttgctacaggcccatggaggtaccctgcctggatctataacgtaagagtcatagattaatttgaattgtgtattctaatagaggctatttttcctaataatagtttttccctggtttctgctagcacttggtgtcacggtaaggatcttaccaattttgctgactatttaggacttagttatgtttgaagcagcctaatgtaacagaaagagcatgggttctggcctcagaaatttattaattggaattctattgtgaggaagagctgtctcttcttctccatttgtttatttgacatttagttatatttgtatagattcatggatatttattttattctatggtttaacatccagtactattatttgttttattgctcaaattgttcctgctttgtccattaggagctccttcaggttggctcttctcaagtttttgatcatttctacaagaggttccaaactcatcttgtattttccctaccccagttctggaatcaaccatgtctccaaggaaccctagttcctttctttttttgttgatggaaaattgtgtttagaagccaagatttgggtactagcgccagctgtgtttattgttaccagagttttactgcttctaagcactctgagcaggtagagctcagaaatatctacctgtgtagtaacgtacacatacactttcatctatatttttgtatatatctatctgcatatatattacaaaccatgagtttatactgacacctctgataccattccaatgtgacagggttcattttggctttccccctttccttatttgtaacttctttctccaacagtaagaaacccagctctcatctgcaatctatttatttacttgctcagttctactatacacataaagtagtttcagaattgttagcctatatccctgtgggaaacactttctatgaaatagattacagcatttatgtacagttctttttatctttaggcatagagtatctaagcaagataatgtttcccacagttactgtttgtattcccttttaggcactctccccctaaatcttagttacttttgtttgtttatattttaggtatgtgaaacataatggatctaagagtcagagttacacaaaaagatatactcagagcagagaaatgcaaattaaaaccccaatgagatatcacctcatgcccattaggatggctactgttaaataaataaatagataaataactgaaaataaaaggtgttggcaaggatgtgaagatatagagaaattggaacccttgtacactgttggtgagattgtaaaatgatgtaactactgtggaaaacagcatggaggttcctaaaaaaattaaaactagacttaccatatgatccagcaatcccacttctgtttatatatccaaaataattaaagcaaggtctcaaagagatgtcttcacgaccatgttcatagtggcactattcactatagttaagaggtagaataacccaaatgtctatcaacgtatgacctgataaacaaaatgtggtatatacatgcaacagaatatcattcagccttaaaaaggaaggtaatcctgtcacttgctacaacatgggtggacattgaagatatgctaagtgaactaagccagtcacaaaaagacaaatactgtatgattccacttatgtgaggtatctaatgtagtcaaattcatagaaacaaagtagaatggtggttgccggggactgggggataggtgggaaagggaagttgtttaatgggtatagaattttagttttgcaaaatgaaaacattctggagatctgtttcacagcaagcaatgtgaatatacttaacactagtgaacaacacacttaaaggtgattaagatggtaagttttatgtttatatgtttcccatgattttccaatttgtatttgtataaatttatgggatataagtacaattttattatatggatgtgttgtgtagtggtgaagtctgggcttttagtatatccatcacctgaataatgtacattgtaacaacttagaaagttaaatactggatgttctcacttacaagtgggagccaaataatgtgttcacatggacctagagtgtggaacaattgacattggcaactaggaagcataggaagtttgaggggagtgggtggtgagaaactacttaatgcatacatgtaccacaatttttttcaaaaaggaaaaaggatatactcagtgaggtaaatgtcattccctctccatccctgcaactctgttcccattcctatttcccacccttatttctacctcttttctaccattattctcgctacgcctgtatttaacccatctctttagtttctggtttagccttcttgtatttcttttgtacaaatgaacagatacctgtgtattttattatatcacctttttttctcatatgaatggttgggtactgtatgtaatgattgtatactctttgtagctttgctttgttcagtatttcctggaaatcatttcttaccagttcagagaagtcttccgcattcttttttgcaggtgcatagtacttttattgtggacatgtgccatacatatcaattcaccccccttcctatgtatgcacatttaagttgtttccaatgttttgcaattaaaaacatgctgcagtgaataacctgtgtgtatatatttttgtattgtcagaggtttatcttaagggtaaatttctagaagtgggattgctgggacaaaaggtaagtacatttctacctttataaggtattgccatatttgcctccagaagagatgtaccagtttgcattcctaccagcagtgtatgagaaagcctgtttccccacagcctcactaatggaatgtattgtcatactttttcaatttttggcagtctgataggtgagaaatgctatctcagtgttgttttactttgtatttctcgtattatgggtgaatttgagcattttttcatatgtttaagggccacttttatcccttttgctggtgaattgtccatgtcttttctcatttttctattgggttttttggtcctttggcctctttttaaaaataaattgtggtaaaatatacataacataaaatttaccattttaattattttaagtgtacaattcaatggctttaaattcattcacaatgttgtgcagccatcaccaccatccacctccaaaatttttttcatcttgcagaactgaaactctatacccactaaacaataactcctcatttcctctctcctcagtccctggcaaccactattctgctttcagtatgaatttgactactctaggtacctcatatgaatggaatcatacagtatttgtcttttcatgactgacttgtttcatttagcataatgtcttcaaggttcatccatgttgtagcatgtgtcacaatttcctttgattttaagattgaataatatttcattgtattttgtgtatccattcatccattgatggacacttggactgcttccatcttttggctattgtgaatgatgctgctataagcatgggtgtacagctaggtgtggtggtgcatgccgaagtcccagcaactcagtaggatgaggcaggaggattgcttgaacctaggagttcaaggctgtagtgtgctaaaatagcacctgtgaatagccactgcgcttcagcctgtgcaacatagtaatattccgtctctttaaaaacaaacaaacaaaaaaacatgggccaggcgtggtggctcatgcctgtaatcctagcactttgggaagcaaaggtgggcagattgcttgagcccaggagtttaagactagcctgggcaacatggcgaaaccctgtctctacaaaaaatacaaaattagctaggtatgatggtgtgcacctgtagtcccagctacttgggaggctgagttgggaggatcacctgagcccagggaagttgaggctacagtgagctatgatcataccacgcactctagtctaggcaacagagtgagaccctgtctcaaaacaaacaaacaaacaaaaaacacacacaaaacaagcaacaacaacaaaaaaactatggatgtacaaatgtctgatcatatccctgctttcaattcatttgggtatatacctagaagtaaatagctagatcatatggtagttctgtttttaatttttaaatcaaaccaccatactgttttccatagtggctgtaccattttacatctccaccagccatgcacaaaagttccagtttttccacaccctcaccaatgtattttttttataatagcaaccctaagtttggcccttatttttgacaattctttatatattcgtgatattagccctttgtctgtggtgtgtgttacagataatttctctgaatttatcagttgtcttttactttgtttatgatttttttgtcatataaaatgttatgatttttatgtagtaaagcttattaatttttttattgcctctggattttttcagcagctttattgagctaaaatttacgtaccataaaattcagtcattttatgtgtaccattcaatgatttttagtaaatttacagagttgtacaactatcaccacaattcaggtttagaacatgtccatcaccccaaaaagtttcctcatgcccatttgccatcactctcattcccactcccagaccaaggcaaccactaatctcttttctgcctttatagatttgcctattatagacatttcgtatacatggaatcatagaggatgtagtctttttttgtctggcttctttcacttatgttttgtggttcatccatgttatagcacgtgttagcacttccctttcttgcgtaatagtactccattgtctagataggccgtatttgtccatccatttaccagttgatggaggtttgggttgtttccactttttggctttcataaatactgctgctgcaaacattcacttgcaagtttttatatggacatgggttttcatggggtaaatgcctgggtatagaattggtgggtcatatgtttaactttttacgaaactgccaaactgttttccaaagtggctatatcatttacattctccccatgcctctggattcatagttagaaagcctttctccacaccagggttaaaagaggaattcagccgggcgcggtggctcatgcctgtaaccccagcactttgggaggccgaggtgggcggatcacaaggtcaggagatcaagacaatcctgcctaacacggtgaaacctcgtctctactaaaaatagaaaaaattagctgggtgtggtggcgggcatctgtagtcccagctacttgggaggctgaggcaggagaatggcatgaacctgggaggcggagcttgcagcgagccaagaccacgccactgcactccagcctgggtgacagagcgagactccatctcaaaaaaaaaaaaaaaaagaaaaagaggaattcacccatgttttcttctagtaataatgtcgttttatgttttacatttcattttggcatttggtatttattcttatgtatgatgtgagcatactttcaatatttttgttttcaattattcatttttttctgattataaaagtgactaattgcttctagtagaacatttagagaagtatagagaataaaacttaaagttgctataatttcaccacccagagatgactacctctttcttcctaattttccccctttagataatttagtctgggtttcctgattacattttattctcactatactcatttagaagcaattgacccatcttcctttcctttcagtttagcacaaaaagttccagacttctgattgtctagaatgtgctaaaggaaatagtttcagctgcaaaagtaatagattctaagaaacagttgatgaatcaaacaattaaacttaattgttcaatattttacagagaaataaagatgctccttttcacaagaatgtatatttatatttttagagacattttataaggcttgttaacaaaaagtacattttacatatatgaatgttttcactttttgtccttagattattttcttttgttttttaacatgtcattgaagcttttgtatttattttctgtgagtgtcggtcaatttgcacatgctcagtttacttgaattcctagccttggcaattaaatagcatgtgaaaacattggttttctgttatattttctttttcagtctgatttttgcctggccctagtcctgtttttgctttacttttaaagattttacccattacgtggctgtcctatatcacgtggtcctataatatatctataatcttgccaagaactcttttttttccttattactgtgagagcttttatatccagtattctctgcattcatatagtacctatctctgtagtcagcatggtagttaagagcatggactctgaaactagactgctgagctcaaatttcagcttcacattacctactagctgtgtggctataggttatttaacttctttgtgcctcagtttccctagttataaaatgaggataacagtagaacttacctcataggggctattgggagaacttaaaaaatttaatgtatgtaaagtatttagaatagagcctagcccataatgctatagaagagttaactattattaattatagtggtatttaaatattcaagcatttgcctcaaattacaatgaagaacctacttctatgtgctaaattttccttggaaaaatcaacagttaaacttaaatatgattttcccatttagagaaatcctggaaattttttagggaaataaaaaactatcgagttaaaagtatcattactttgaagcttgtcagcttacatgaatgacacatggaagttttcagtttaataaagaaataacgaaataacacttaaatttactaatagttttttttataatctgcattttaattgaacattccttcataagagtcttagtaaatgctcaacagtgtaatatgagaccttattgtgtggccttcctattaacttttgataaagtgccttctaagatcttctataaaaattgatggaggtcttaagatgggtgagagggcatctactctattcctgaagtccttttctatcctttattgagattgagaacagctgttccctgtcctttatttttctctttttcatagccttgacaactattcatttttcccctcagtcttcttcagatcaaatcttcatatttcttctgatctttttttaaccagtcctgttttccagtcttttgaacatttcatcccagtggattaaaacaaaaaacagccctacttcgtattggtctgctttactagtctggaactgatatcaagtgatatgtatacattccaaagtttcttacctatatgtattccttcaagctatttctgaccctcccttttcctcgtatttgaaatggacaccattgttgtcatgactcactctaagtaatttaaaattaatagacaaatgaacaagaggctatgggtcataagttccaagcaaagcaagcatttagaagggagcacttatttataaagaattgtgaaatgttttctgagtggccgctggtcatcatttcaactttttgacttctcaaatgctgtttccctaaactttacaataaatgggaaatatatttatgttgattaggttgaattttgaccctgagcagtgtcacttctacctcccccatacctctcccttctctacttccctaatctttaattagggattgagggtgggaagaaaagggacagaacatgtattttagctccagttagctataacttcatacctacaggacacaaacagaaaagatcctagccaagagccaagatagaggttagtcattcctgttgcaaccgtatctggctctgaattattacctttctccaaaccactgaagtacttcagagatgtgtttattgtacatccaatattctacctgactaggaggatagattgggttggacacacttttcccagacttttgtggtataattttgacctaatccccctacctatccaaaaggcctatgggatatatttttatccacctttgatataggtattatcaatcagatatttttctaatatgttatttactttgttttagtgtggaaccatcagagaatctacaatccctgatggagaagaatcagtccctggtagaggagaatgaaaaattaagtcgtggtctgagcgaggcagctggtcagacagcccagatgttggagaggatcattttggtaagcccccaagaataaactactagcaatctgaacatttactagctttagtttccagaatatttaacatgtatctcattatgagagacaggttatattgaaagaaatgtatttgtattaccatatcctccagggagcccctctggggtaaatatgtgggcttataatcaaacatacagaaaagttaaaagaattgtacagtgaacacctatgtatctaccacaaagaatctacataaatcccattttaaaatagattcatttaaaaataccagaaagtaaagaaccaagtacctctgtcaccttaaatcctgcctaatctttatccataataccaagtaaccattccttctccaagattttagttattttccatctctcttcccctaatgttgtcacatttcatatcccatactaacagctgccatggtgagatacaacagcttggaaattaattttaattcattttccatgtgattgatttccaaatagtggatcactatataactgattacacgagttctgactcctactacctgcttgtctgtcagtaacctcctggatcagtgcatgctgactctatcactaaggtttttctactagtctaaatacaactcaatctttgatagcacgactgttgccagaagcaaaaataagtttccaccaaaatataattgaacctctgtaatgtatacaccttcatgcatcagtgtgctctctagtcaaggaaagataagctgcttaaagatttctttcaagtgggctaaatcctacgtccattgtattgtccattactaacggagggtgaaaatgggatataggggatttttatatacagttttctgtctccagtgctgtatttatgctttgaagtaactctagaagctgtgtttcacatgtatgtgaatgaggctgttgtaacagaaactacttcttattctatccacatactcatccgacctttataaggttgttacagtgtctgcctgataggcttattgtttgatatcctgtcagaacttcataacaagcacaacatttttgtcctatataaacgattctttccagatctgttatagtatccagcatgttacagatactgtgattgaaataaaactgaaaatatcaatcacccttcccaaaacgtaagctgccttctgctgtttcttctttctctaccatcattcttgtgccgtaccctttttcttgctgtcttttgctaaaactagcctaccatatcaaatagtataacttaaaaaaaaaatctcagctcaaatttagtgtgaggcccttttatgttttaaatgcccttatgctggggctagggaacagcgtagtgtaggaggcagtttaaagtaagtggggttttttgtttgtttgttttttgtcttttttttgtttgttttttttgtttgtttgttttgcaaacagcagggactaacatgccaggaaatattgctttttcccctcagttgcaaagttctctatggaattaaggcttcacactccaccccatagtctgagtttcatggcaagcataaaacctagctgctcggatgctatttttagtagctcatgttgactgaagggctaatttccatgactcttttaaaaaacacatttttcactgaataaccaaagcccactaaatcctctgttacagcaaaggagacagcctctctacctagcttttaattcataggagtaggagagcataattatgtgaggctgtcaggcaccgccactgatgatctcctgggtctttgttgcagacagagcaagcgaatgaaaaaatgaacgccaagctagaagagctcaggcagcatgcggcgtaagttgcccaccagatatttgttagcaacctatagcatcttagtatataatcgtggagcctctggcctttgtcatatgaataacccttgggttctttttgtttgaattttcagctgcaaactggatcttcaaaagctagtggagactttggaagaccaggaattgaaagaaaatgtagagataatttgtaacctgcagcaattgattacccagttatcggtaagccaagtaggggcagtgtaaataggcatatcactttcatttgtttctcttgacacatacaagcctttctagctctgtgccttttgctgaaacaactagattgtgagccgcttttggacagaggtcgtggatcatttgatatgatctgaatattgagtttgttaaaacactcataggttacatatacaatgcacattagtatttcagtattctaatcaaataacagaagcaacaacatagcagtgcaaaattgcctaggtagcaagagcagcagtcattgatttgctgtcctcacagtgtaggctaacttaaaaagaggacttgtaccataccccaattttaaataagctaaattctgacagatagcttaaggcaaccagggaataccataagcctcttttataaccaataataagtaagtttgaatgattgttctaccataagttcccatttttgtttatttttagaaccattatagtagtggcaggtgtgttttgggggtggggtggttatttgttgtttttcccagaagaaaaattttcacaatcccactatccctaaaaatctatttttgttttggtgttccatctcttagtccttaggcatatatgcttttaaaaaaaacattgaaatcgtactataacatactatgttaagtggtaatggttggttttgttctgtctacactctgttgtttattattctgaaacagtgatgtgtatgcagatgcctggtggtaattcctagctcttgggcagagattttaattttaccagaaccatgagactgtagtccctggtcttgcccagtgttttctagagttgtcaatagtgtgtcacaaaattatccacacatagatttattcttgaagagaatattaaaaaaatgccatgcaatattgtcaggacttgttatgatggccagctctaagaaattaaatgagtaaactccccaaagactattaggcagtgttttagaataaggagtactgtaaagctatcatgagcagtccaagatgacagctcatttatccaacaaacagggtacagtaattgagagcctgggctctagagccacacagaccctggtttgaagccagttctgccacttcctagctatgtaatcttactaagtgctgtattactatcaaaaggaaagaatttaagtgattcaaataggggttaaaagcattattcatctgggcgcagtagctcttgcctgtaatcccagcactttgggaggccaaggtgggcggatcacctgaggtctggagttcaaaactagcctggccaaaatggtgaaaccctgtttctactgaaaatacaaaaattagccaggtgtagtggcatgcacctgtagtcccaggtacttgggaggctgaggcaggagaactgcttgaacccaggagatggaggttgcagtgagccgagattgtgccactgcactccagcctggatgacagagcgagacttcatctcaaaaaaaaaaaaaaaagaagaagaagaagcattatttagctgatgcactcagggtacacttgaactccaggtaacttcccaagtaaagcaagattggagctttatagagtaaagagaagaaagggttgtatgtccgtgtggtttagctcaggtaacagtttttaatgttaattgatgtgaaacttttggttggagattgtttcatttttttatacctcttcctcaggaatatactgatgcaatcctatccggataactgttattatattttgagagttgttcttacaagccttgtagtttctcagttggtcaaggttcacaggtgggagaggtggcaaaatagggataacggggaaaggaggcgagggttgaaggcaaggaaaattgggaatcctctctcgtgtgctttcttttatatcagcaatgtaagcaaagtgcagtgggatcataaaacaaaggatgattaactgttagtccagaaaattcaggaaggcatcatagaagaaactgggtcctaaaaatgaacaggagtttgccatgcagacaaaagggaagggacaggccaactctgggcacactgcttacgagttagccctgctccacaaggaaaaatttaagagcttttatataaaataaataaggttttttaaaaagggactagactatatatagaggaaaagatatagataaaagcaaagaggtatgaaagtttaaaaaatggtaagaacttcaatgtggctgaagtatagagtacttgttagacaacggctatcacaaggttaaatttcacaattataatgccactcaaatgcaactgaaacatctgatacatgaaaaccttgtgtgagctgcctcagaattaagataatctaggctgcagaagcccactggggccaaaacttacaagctcagaaatagtgacccagggtacccaccattgttcatggccatcacaccaatcttagaggattaataccacctcatttctggggcttcgagtcacatagaaaagatgaaggaaacccgtggaaccaaattaataaaataaagcatcctcagtgagaatctggcaatatgactggtgcctggtgtgcctgtagagggagttgctagtggtggctggctcagaggaactccgtagaatcgctgtgtctgccacttaaatgtacttggcacacacagtaggagggtgctaaagattgccacaaactgataaagttcctggcttccatccactgtcacagttaggcagagtaagcccttttatccaggagtcctgctggactcctgaatcagagttctccacatctattgttcggagaccctcccagctatatatttttttggaaatacacaacaatgtatcccatggcttttattaagactcactacagtgaaagcaaaatgtttcaaaagtaagtgcttgtgcccttcattctggattaaaactatttttattttaagtgactagtgaacacccccttttccattataaaggcaaccattgttcctagatattcttcctggggctttaagcgctaaactgtaccatttcttcctttaaaatataattcaagcaaacctccttgtgcagttacctgtgaggaaattcaagcagtcctttcagttcctacaaaatcaaatgatcttttttgtttatatcccctcctccaagaccagttccataaaaagcattttgcatgcccagtaacggtaccgcctacaaacacaaacttcatcttggaggatattgctggttaatgtagcacagtgtacccttgttcccctaaccatcacctttatgaaatcacgttttatttttaagaggttcttggttatagtcttagaatcgggggaaagagggctgtgagactgaaataaatcttattgtcatatatttacatttaggattatagaggcagaattctgccatgttcatgcagaacatgtcaccatagccctaagcttaaaccttagtattgtaaaatttcactgggccaaaagccaaagataaacccagagtaacaacatatcttcttcaaggattaacccatctacttttgatcctaactctggaaggtactagagaaagtctccaaaggccagtgttttaggccctaataatctaggacaggcctctgattagtccttatactgaaaattgaaacatgggagggaggaaagggtaaccattatagattttttttaatcctttttaagaatgatttagggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaagaatgatttagtatgtcctgcacttggagaatcaccagtactacaaatcatcatgagaaaggatgtgggaatactgaagcttcctttaaattctctttgagcctcactggttgggagtttctgagcagaataagggaaatgcttcataaatagcacttattaaggatctcttcaggccaggcgcagtggcttacgcctgtaatccaaactctttgagagaccgaggcaggtggaaccctggagcccaagagcttgagatcagcctaggcaacacagtgagaccttgtctctacaaaaaaataaaataaaatgagaccatccttcatgacatagtgagaccctgtctacaaaaaagttttttgtttttttgttttttttagtatttattgatcattcttgggtgtttctcagagagggggatgtggcagggtcataggataatagtggagagaaggttggcagataaacacgtgaacaaaggtctctggctttcctaggcagaggtccctgcagccttctgcagtgtttgtgtccctgggtacttgagattagggagtgatgatgactcttaacgagcatgctgccttcaagcatctgtttaacaaagcacatcttgcaccgcccttaatccatttaaccctgagttgacacagcacatgtttcagagagcacggggttgggggtaaggttatagattaacagcatcccaaggcagaagaatttttcttagtacagaacaaaatggagtctcctatgtctacttctttctacacagacacagtaacaatctgatctctctttcttttccccacatttccccctcttcttttcgacaaaactgccattgtcatcatggcccgttctcaatggtcgctgtctcttcagagctgttgggtacacctcccagacggggcggccgggcagaggcgctcctcacttcccagatggggcagctgggcagaggtgctcctcacctcccagatggggcggccgggcagaggcactcctcacctcccagacggggcggccgggcagagacgctcctcacctcccagacggggtggccgggcagaggcgctcctcacctcccagagggggcggccgggcagaggcgctcctcacctcccagacggggcggccaggcagaggcacttctcacatcccagacgatgggcggccgggcagaggcactcctcacttcccagagggggcggccgggcagaggcgctcctcacttcctagacggggtggcggccgggcagaggcactcctcacatcccagacaatgggcggctgggtagaggcgctcctcacctcccagacagggtggccgggcagaggtgctcctcacttcccagatggggcggccgggcagaggcgctcctcacctcccagacagggtggccgggcagagacactccctacttcccagatggggcggccgggcagaggcgctccccacttccctgacggggcggccgggcagagacgctcctctcttcccagacggggcggctgccgggcagaggcgctcctcactactcagaccgggcagccgggcagaggcactcctcagttcccagacggggcggccgggcagagatgctcctcacatcccagacggggtggtggccgggcagaggcgctcctcacttcccagacggggtggcggctgggcagaggcactcctcacttcctagtcggggtggcggccgggcagagacgctcctcacctcccagacggggtggcggccaggcagaggcgctcctcagttcccagacggggcggccgggcagagatgctcctcacatcccagacggggtggtggctgggcagaggcgctcctcacttcccagacggggtggcagccgggcagaggcactcctcacttcctagacggggtggcggccgggcagagacgctcctcacctcccagacggggtggcggccgggcagaggcgctcctcagttcccagacggggcggccgggcagaggcgctcctcacttcccagacggggcagccgggcagaggggctcctcacatcccagacaatgggcggccaggcggagacgctcctcacttcctagatggggtggcggccgggcagaggctgtaatcttagcactttcagaggccaaggcaggtggctgggaggtggaggttgtagcgagccgagatcacgccactgcactccagcctgggcaacattgagcattgagtgagcgagactccgtctgcaatcccagcacctcgggaggccgaggcgggcagatcactcgaggtcaagagctggagaccagcctggtcaacacggcgaaaccccgtctccaccaaaaatacaaaaaccagtcaggcttggcggcgggtgcctgcattcccaggcactcggcaggccgaggcaggagaatcacgggagccggaggcagggaggttgcagcgagctgagatcagggcagtacagtccagcctcggcaacagagggagacgggagagggagagggagagggaaagggagagagggggagggggagggggagagggagagggagctgggtgtggtggtgcacacttgtagtcccagctagtcaggaggctgaggtgggaagatcatttgagcccaggaggtggaggttgcagtgagctgagatggcagcaccgcattccagcctgagtgaaagagcgagactctgtctcaaaaaagagcgaggggagaggggtctcttcacttctcacattaaaggtactaaaagttaagtttcaacaactatgtaatgtttcataagggtgatatagagactccatgtactaaccctaaattcttagctgttgagctaatagctttttcacctatgacctccttaagtacatgacttcctggaaataattcttttttcccagggctttgaagaatcacttacacagaagtggtaatccatatcttacaataccaaataaagcctaaattccagtggtgagaacagagcttgctaatatgatagcctataaacaaattagtcctattaagtagtttagttttcccttctaggtggcatttgtttgaatgccccaaaaaataatttgccaaagaattagtgcttacccttttcctcctagttacctggagtagcaccatatcatctgttctttttttcccttttttctttttttctatttttagatttagggggtacaagtgcagttttgttacatagatatatcgggtagtaccgaagactggatttttactgtagccgtcacctaaatactgtacttcgtacccaataagtaatttctcatccctcaccatcccccaaccctttcactcttccaagtctccaatgtctgttattccactatgcccatgtgtacacattatttagttcccacttataagtaaggacatgcagtatttgactttctgagttatttcacttaagataatggcctctagtttcattcaagttgctgcaagagacatgattccattcttcttatggttgagtagtgttccatggtgtgactattactattccagtagtagtccatggtgtatcaatggatgatcagataaagaaaatgtggtatggtatacacacaccacatacacacttagattgattccatatctttatgatcagttcttatttacatgagggacagaggctgcagtacctttatctgacttcaagagcacacttttctgggagtacccatctaaggcatttatttctttctgttttttgtttttgtttttgtttttgttttttgatttttgttttttcttcaagatggagtcttgctctgtctcccaggctggagtgcagtggcacaatcttggctcactgcaacctccgccccccaggtttaagcaattctcctgcctcagcctccagagtagctgtgattacaggtgctcgccaccacgcccggctaattttttttgtatttttagtagagacggggtttcatcatgttggccaggctgatctcgaactcctgacctcttgacctgcctgccttggcctcccaaagcgctgggattacaggcataagccaccgtgcctggctaggcatttatttctttatagaggaagatcctgctaccttgactgactataaaaataaaaaataaccattctatttacttttctgatgcattgccattatttgatatgtctgttcgtagaatggtatgtccccataagaactggctaggcttgtacattaatagaggtatactaagcggtagatgcataaaaagaaagggtagagtccataaaatgggttaaactttggccttttggaatggctaaatgtttcactctggcccaaatgtctctggcagggcaggagaagtgcaagaaatatgtcagttgccacatgaccttattttttataagagctacacaattgtcctttatgaagaagaaagactcttgagagatgggaaatggaaacgtgactattggggtttctgtaactataaaatgggtccaatatcttaaacagtctctgtatacacttaaaaaaaattaaataaccaatataaaatccaccagtaagctttacttcagactctttccctaaaccaaaacatttgttactgcaggatgaaactgttgcttgcatggctgcagccattgatactgcggtggagcaagaagccgtaagtaattggcccctttgtgtagaaccaggagctctaactgccgtttcctataatttatcactcaactgaaaaagagaacctgtgattgttaccatcctccatagaatgcctgttaaatccagaaatctttagtgtaaatctcagcttcataaaatccctaccttggataggctctaccactaatagtataactggtaatggggggcaggacttctcaagaatgtaatgttccatatttgcaacccagctgactgatttcttgttagaggctagtattctgcatcaaccgtccagcaagttaaaaatgaggagaggaaaaaatgaggaaattatggcaaagtcaaaaaagcattagaggagaaacagaagagaattttttctatggatgagatattaggggctaaaagaaccaaggaaaataatttaagtgttcagatcacaaggatagataaaatgtgttagatgttgactaaaggttataaagacaaaatgaaaggctggatgatggattgcttgagacaggcttttctccctaaaatgaatctatgtcagtagttttcacattctgaaagaaggaaaatactaggtcaggtactagaggtcagctgtgtgagaacaaatgaacccttttctcaatttccaggaccttctctcctgtaagaaccccttggaatgaggtaaaagtaagaaatgccatccagatcaataaaggaaagagcaaagaaagttagttgatactaaaagagtccattaaagtatataagaaataaggtgcttgagagagcagggaactaggctagctatttatttcagatacttaaaacaaatgtatgcagagccactgttgtaaaggaacagagatattgttaatggagaagtgcctgtgagacttgatgaaatagtgcctaaggaactccatttgcttgtttctcttataaatcattatcctgatttttttccagcaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggtaaactatttcctagggcagtatttgttcatgtctacagtctcttaaactgaatgggaagaaaacaacaagcatataatttttgatgatgaaaagacaacaaaatgtatatagtataatgggagttgtactgttggtttaaaaagaggatacattcaggacagggagcatgtaattttgttccatttaatctaatgccttaccttatgccacaggtatttaataaatagtttgataacattataataaatgtggtccctacttatagagaaattatattctaataactatgcttggattctgagaaaaaacacatcttttggtaaatagtctgggttatagtatgaattatgaagacactagtggatgtcacatgacttgacaaatggctaaacttttttctgatgatagttctaagtggcctttgccaattaatagtcaggtctttacttaaaggcaaatccttggctttcaggttacccacaagaaatggcccttgctccagacttattttcccttgcagaccagtgtttctcactgtttgtaattacagacaaagggatattaggatgggtggtagggggaagaatgggttgttttcctgtccagctatatcctactactcccaaggtattatgtgtttatattgaggaacagctctagtatccatgctttcttattcccccatggcaactgttcatatgacatactttatttccaatctacaaccattaaaaacactttattactttacactgtacagttgttctcacatctgaaataagacacaggggcagggagagcttttggattggactgcagttgtcctagcaccctatctatcctgggaagtagccttttgaagacagaagtggggaggagagaacagtggacaagagaggtggacagttggcccaaggatgcccttggtcccttccctcctgagggccttttccaggggatcccccagggcccacgactgcaggaccttcaccaggaaaccaggctgaatgggaagagggttcacagtattggcgggggctgggaagtggggccaggatgaggaggaaggacagcttctggctttcttcccagctgctgggggttggagctgttttttggcactgtctacaaggtcttcctggggttgggaggaggaggaactgggggtttaagattctttccttgtggagttaggattctttccatttgaagaggggccatctggtctatggtgaggttcccaaggcataaacagtcagggtcttctgcctcctgcctccccaggacttccacccctgcctggctggcatcatctagacagccttttgtaaaaccaagacaagtgagagaggtgagcagagctggaaccaagccaggagcagggaaagaaaaaaatgtatgctttctccaggccctccaatttatcttcctcttccaagaggagagactatagggttggtttttgttggtggtggttcccaatctcagaagtccagatgaggctagtgttttctacctgttcttggtctagacagccccagtccctccccaggctacactaatggctggcctagatcagtagttggcagattctcatgcatgtcagaatcatccggaaggctccttaaaaccccagcttgcagggccccattccataagctctaattcagtgggtcttgggcggggccaataatttgcacttctatcaagttcccaggtgatattcctgctgctggaatgcaatacgagaaccactggcctagaatggtgcccacagtcacatcctcagcaacctggtgtctcctgggcagtactaaggagctgggccacagctggcaaagcccagccttaggggtaccaacatcacctgggaagctgctgggaatggtcttggggtgagcgcccggtgcagagaagtaaactaaggcacagagttcagcggcagagctgggagaggagcaggataccagggcccagtagagaacggatggggctgcaggaccctacaacaagtactcatgctttttttaaattgccagctctcatacgttttcagagtaaagacaaaaaaagtgtttctgctaattaattttcaccactttttccccctaggttagaggttgcttccaaaataataactgagttgccaatagagatttttttcccttttgttatcatggtcttttttaacttttaaaaacttagttttttgtaatgccagcactttgggaggctgcagtgggcagatcacttgagcccaggagtttgagaccagcctgggcaacatggcgaaaccctggctccacaaaaaatacaaaaattagccgggcctggtggtgtgagcctgtagtcccagctacttgggaggctgaggtgggaggatcacctgagcacagggaggtggaggctgcagtgagctgagatcacaccactgcaatccagcctgagtgacagagtgagaccatcccaacaaaaaaaactttggctgggcatggtgctcacacctgtaatcctagcactttgggaggccaaggcaggtggatcacttgaggccagaagttcgagaccagcctggtcaacatggtgaaaccctgtctctactaaaaatacaaaaattagctgcatgcctttaatcccagctacttgggaggccgaggcgggagaatcgcttgaacccgggaggtggaggttgcagtgagtcgagattgcaccactgcactctagcctgggtgacagagtgagaccctgtctcaaaaaaacaaacaaacaaaaaacttaatttttatctatgtcaaacaaatgcatatatatcattttttaaagtcaaatactataatacttagaaaaatcaaagcagtcctctattcctattctgacatttacctccatatttctagataagaattggcagtataattatgttacattttttagataaatatctattgacctcccatgatggaagacaagaacgtagctctcttatcccaccacctgtgcacactgcctcaccttcttctttcaaaatggttatatcaccctttttgtttaaatgagtatttagtgtttaaatttttctgattacataaatatgtttaaaattgagccatatagtatgattgcatttcctttcttgtatagctctttgtatttgctagagataataatctcattttttccatttacttagttttcgatatacctgtcaataattttatctccaaacttcttgacaaaactgtaaaactcatcccagcactttgggagcccgaggcgggcggatcacgaggtcaggagatagagaccatcctggctaacacggtgaaaccccgtctctactaaaaatacaaaaaattagccgagcatggtggcgggcgcctgtagtcccagctactggggaggctgaggcaggagaatggcgtgaacccaggaggcggagcttgcagtgagccgagatcacgccactgcactccagcctgggcgacagagcaagactccatctcaaaaacaaacaaacaaacaaaaaaactataaaactcttcattgtggtcagacataccagataatttatcaatccatttctttcctgaaaacaaccgttctggaatcttctgtcctggtttgctttctctagggctgttgcccactcaccagtttgggaccatcatcctggggatttgcttcacttctttctcatctgtgttgacatggatttcatgtcttcctcctctttagtatacccctttgctttggtggagtaaaaccccaatagctttctgagaatgtatacatgaaagggaaatactttaaagctttgcatgtctgaaaattgctttttaaaaattcttttacttgttagtttggctgggtttacaattctatagaaatgttttcttcattattttgaaggccttgctccattgtcttctgtttccagtattgctgttgagaagtctattataattttggattatttgttatagacctatttttttttactttggaaactttcaggatcttttcattgtccccaggtgttacttaatttcacaatgatggaccttggtatggtttcctgttgtttttttgttgttgttgttattattgttgtttttatagagacagggtcttgctctgttacccaggctggagtgcagtggtgccatcacagctcactgcagcctcaacttcctgggctcaggtggtcctcctgcctcagcatcccaagttgctgggactacaggcatgtgccaccatgcctggctaattttttattttttgtagagatggggtctcactatgttgctgaggctggtctcaaattcctggtctgtagtgatcctcccagcctcccagtcctaaagtgctgggattacaggtatgtaccaccacacccagccttcttttctcgtttattgtgcttggtgctcgactggtcctttcaatctagaaatttgtactcctttctgggcggtttttttcctatcatttctttgataatgctatctctacattttctctgttttctctttcttgcacttctcttagtcagatattggacctcttagatttagtttctgcttttctgatctctttcttcctattttctatttctttgtctttttattccactctgagagatttcccttcattcttagtgaattatttcatttggctattaatttccaaggtctccttttgatcctgtaattgttccttcttatagccttttattctttttgtgtggatgcatagcccatctctaagaataggaattaaattttatcaaggttttcttcttctccctgccttgcctttgtttcctccagatttcctttctctactgtgtttgttttggtctgtctttcaggtaagatactttcctacaatttctagtgagccatggctatccattcatatttaagagggaggcactaaaagccaatagcaagttgtatgtgcatggatttctcttaggctagtcaatttccaataaagaaatcttttattcttttgcctagagttgtatgggcctagtggtggtatgccatcattctagtaacccagacaaaataagggagttgaagtctctccaatcatagacagacttttatttaatccctgtcagcagtatggtactgcatccctgctattagctgtgtccaacctgttaggttcggcctctccagaaaggaagcctctgctctactctgtggctctgtggtacatattggcatgcttcttcttgatgtttgtcctgtaggagttatattttagctttttccactctggatgtcagttactgcttatccagctgttttcttcttccaaaagtttgttgatatctctcaactgctttccttgtctcttttcattctcgttgatttatacctccttttttgttcattttcatgtgatttcaggagggagtaagttaaatatgtagctcaattgtccatgttaataggacatacaatgcagcctctttaaggtcaaatgtattttggcttttccaggataaacaaaggattactggtaaggctgagaagtgattcctcctttcttgtactcttgcctagaaacatggggatatgtgttcccccactgtatttctttctttctttctttctctctctctctctctctttctttctttctttctttaaccggagaggggtatatttattttctcacattttaaaaaaaaaaaaaaagctgaacataagtagtctggggcacgtacagcagcaaaggcccaggatccttcctgctttctgcttccttggccttagggtgtgaatcttttcctcatgctctcaagacagctgtctgagcaccagccatcacatccacattccaggcaggaagaaggcaaaggtgaagggtactgcacatgtcagctgagctccctttacaggttctttcctgcaagtctctcccgacatcatccacttgcatgctacaactgcccaccctgggttgtgagggagggtaggacatggcttttgcctgcccgcttgtcagaattgggcagaagcactgggattctgttagtagggaggaaggagaatagatgctgggttaacgatttgcagtccccgccacagccaggacttaggcaggggtgattcccactaaaagccaaaggtttcatgcctggctgcaggggagaggtgcttgggctggggtcctgccttgtcttaacaaatacgaggctcttgttaaatatttaaccctgtgagggtggcttgtggcccacgtgcacccgaatcagctgcctggcatgcctcagcccactccagggcttccaattcaccctggggcaggggaggcctggggcacgcggttttcacacacacactcctagctgatttctttttcttctgtaatttataaaattaacactgcacttattggaagacatgaaaatccaaagatgggtagagaaaaagttcacctccctgtgccttgcccctgactaacccacgttaacagtcttacctgctcccaggggattctgggatcatggaaggtccttgagaaactctctagtcctagacaagtgctggggggtgggaggataggctggggagagaagggggctcctcagcaggccgagccttggttgctcaaccctgctggtactgactacacatggagcgaggaatgtgctgagggctcagccacgtgggtggtccttgtggcctctgccactgccctgggtagtcgtcactcagccacgtcaacaagcgacattggggaggcaggcctgggccgcctgaaccgtcacctcagtcctggttgacacctcaggcctggtcattatctgaactttggctgcagggcttctgggcagaaagggcagatccaactggctcgtcctagccatgtgctcccggagcagcctgcccagggatctggagagcagcagccagatcctaacctactctgcaccaacaggcaggaaagggcaccttgagtctgccactgtagggtttcagaagcaggctgacctgaggctttccaaatttcacgagggctccttctaaggcctgggctgtgtccagatgttggaccacatgcaaagaatggaggccgagtccagaaagaggagggccctcccccatgggaatgtgcacgttggaagggctccccatttgcccctagatcctaggctggatgtgggctcaggaggctaacccctatggaccagcccacccgttcagccaatgggcagccacagcaagggcagagggagcagcagaggcagcccacgtggtcacaggtcccgtgggctccagagctctcagctccaggcacccctgcctgccccgcttcgagcctattgggggcagacttcctgctgtgtctggtcactaacctctgcccacaccactaaaggactgtagctgaattctccttagttaaatcctctgctaacacaaaaggaaaaagccaaatctcatctcacaagagctttatttgaggtgcagcatgcatggggccttgccccaaatgccatgggcatcacattcaggaagaggcagacatccccacaacagtcacatgctgaagcttccgtctgcaatgtctggtggcagagttctcactcagcagacctgtatcattatatacatcaccatgttatcaaagtccctggactggatattgtccccgggttacagaaggggttgcacatcacatctatgtaggagttgtgcagcttccagaacatcctgtgaatttcattgtctcgaagagctgtgttggaggaattcaccaccatgacaaacttcaccttggagatggtagtgtagccctgtctgcatagctggttagggaatgcacttgtaagacaaggactgctgggacagcaggtaaagaacctgccagctgagggccctctgtgtgccctcagtttggagaagcctggcaaccttgaatcacaggaagtgcccaggctgggctggtcctgcagtgaccatactgggtgcatgcctacatacttcactgggatgactggtgtttactggagaagcaaagggcaggcagctaagctttacccaattctggctccggaagctgagccattcagactctgagtctctgtgtgcacctgggatgcctcaccctctttgtgaatcaatgcctggtccagaaagttaactgcaaaaccagagacttcatgaataaggcggacctcctctgtagaggccatgttttgtaaaatagtggctactggtaaatgtcaccatggacaagctacattactgctcttggaacgtctttgaactccatggtctcaagtgatttgtccaaagggactggtcgagagtctctagtgacttatgaggcaagaccttgtagtcctctgtggggtagagcaggtccagatagacctctctctggttgaccaaggccttccccattgaggagatcttctcatccaccacatccagagatgtgtgcaccatgtactggaaactcagctctttctccgtgggggtgctgcggatgtagagagggtaattctccttggtgatcaccgggatgcatatcaccatcttgggaggaccagtgctgggtgccccgcccattgtattcctaactctacaaaggggtgctagtaaggagctatagctatagtaagagatctagtctttttccccatggcatctagtccttttccccatggtatcaaatatgcttgattaacttaagaagaaataaattttttttgagacagagtcttgctctgtcacccaggctggagtgtagtggcgcaatctctgcacactgcaacctccacctcttgagttcaagcaattctcctgcctcagcctcctgagtagctgggattacaggcctgtgccaccatgcctggctaatttttgtatttttagtagagacagggtttcaccatgttggccaggctggtcttgaactcctgaccttaggttatctgcccgcctcggcctcccaaagtgctggcattacaggcatgagccactgcacaaggcctgaaataaattcttaatataatcaatatgttttaatcacatgtgaatcaccatctttttttttctctaagaaataaaagcagtttttaattcaattatttatttatctagagacaaagtctcactctctcgcccaggctggagtgcagtggcatgatcatagctcactacagccttgacttcctgggttcaagggatcctcccacctcagcctcctgagtagcatggtatttttcctatcacctgtaaagaattgccaaagaaaaatagggggagggataggttctgattaatgaagattaccatgagttgtagtaaaccaggactcaaatttttgaataattcccccttgtggagttggtaagacaattagggactaaatgtggtgtatataatgaatagaaactatttttctttttttttttaattatactgtaagttttagggtacaggtgcacaacatgcagctttgttacatatgtatacatgtgccatgttggtgtgctgcacccattaactcgtcatttaacattaggtatatctcctaatgctatccctcccccgtcccctgaccccacaacaggccccggtgtgtgatgttccccttcctgtgtccatgtgttctcattgttcaattcccacctatgagtgagaatatgcagtgtttggttttttgtccttgcaatagtttgctgagaatgatggtttccagcttcatccatgtccctacaaaggacatgaactcatcattttttatggctacatagtccatgctgtatatgtgccacattttcttaatccagtctatcattgttggacatttgggttggttccaagtctttgctattgtgaacagtgctgcaatagacatacgtgttcatgtgtctttatagcaacataatttataatcctttgggtatatacccagtaatgggatggctgggtcaaatggtatttctagttctagatccctgaggaatcgccacactgacttccacaatggttgaactagtttccagtcccaccaacagtgtaaaagtgtccctatttctccacatcctctccagtacctattgtttcctgactttaatgatcaccattctaactggtgtgagatggtatctcattgtggttttgatttgcatttctctgatggccagtgatgatgagcattttctcatgtgtcttgtggctgcataaatgtcttcttttgagaaatgtctgttcatatcctttgaccacttgttgatggggttgtttgtttttttcttgtaaatttgtttgagttcattgtagattctggatattagccctttgtcagatgagtaggttgcgaaaattttctgccattctgtaggttgcctcttcactctgatggtaatttcttttgctgtgcagaagctccttagtttaattagatcccatttgtcaattttgtcttttgttgccattgcttttcgtgttttagacatgaagtctttgcccatgcctgtgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttgctgtagccttgtagtatagtttgaaatcaggtagcatgatacctccaactttgttcttttggctgaggattgacttggcaatgcaggctctttttttgtttccatatgaactttaaagtagttttttccaattctatgaagaaagtcattggtagcttgatggggatggcattgaatctataaataaccttgggcagtatggccattttcacaatattgattcttcctacccatgagcatggaatgttcttccatttgtttgtatccccttttatttcgttgagcagtggtttgtagttctccttgaagaggtccttcacatcccttgtaagttggattcctaggtattttattctctttgaagccattgtgaatgggagttcactcatgatttggctctctgtttgtctgttattggtgtataagaatgcttgtgatttttgcacattgattttgtatcctgagactttgctgaagttgcttatcagcttaaggagattatgtgctgagacgatggagttttctagatatacaatcatgtcatctgcaaacagggacaatttgactttctcttttcctaattgaatactcttcatttccttctcctgtctgatttccctggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacgtcccatcaatacctaatttaatgagagtttttagcatgaagggttattgaattttgtcaaaggccttttctgcatctactgagataatcatgtggtttttgtcattggttctgtttatatgctggattacgtttattgattttcgtatgttgaaccagccttgcatcccagggatgaagcccacttgatcatggcggataagctttttgatgtgctgctggattcggtttgccagtattttattgaggatttttgcatcgatgttcatcagggatattggtctaaaattctctttttttgttgtgtctctgtcaggctttggtatcaggatgatgctggcctcataaaatgagatagggaggattccctctttttctattgattggaatagtttcagaagcagcggtaccagctcctccttctacctctggtagaattcggctgtgaatccatctggtcctggactttttttggttggtaagctattaattattgtcacaatttcagatcctgttactggtctattcagagattcaacttcttcctggtttagtcttgggagggtgtatgtgtcgaggagtttatccatttcttctagattttctagtttatttgcatagaggtgtttatagtattctctgatggtagtttgtatttctgtgggatcggcggtgatatctcctttatcattttttattgcgtccagtctatttgattcttctctcttttcttctttattagtcttgctagcggtctatgaattttgttgatcttttcaaaaaaccagctcctggattcattgatttttttgaagggttttttgtgtctctatttccttcatttctgctctgatcttagttatttcttaccttctgctagcttttgaatgtgtttgctcttgcttctctagttcttttaattttgatgttggggtgccaattttagatctttcctgctttctcttgtgggcatttagtgctataaatttccctctacacactgctttgaatgtgtcccagaaattctggtatgttgtgtctttgttctcattggtttcaaagaacatctttatttctgccttcattttgttatgtacccagtagtcagtcattcaggagcaggttgttcagtttccatgtagttgagcagttttgagtttcttaatcctgagttctaatttgattgcactgtggtctgagagacagtttgttataatttctgttcttttacatttgctgaggagtgctttacttccaactatgtggtcagttttggaataggtgtggtgtggtgctgaaaagaatgtatattctgttgatttgggatggagagttctgtagatgtctattaggtccgcttggtgcagagctgagttcaattcctggatatccttgttaattttctgtctcattgatctgtctaatgttgacagtgaggtgttaaagtctcccattattattgtgtgggagtctaagtctctttgtaggtctctaaggacttactttatgaatctgggtgctcctgtattgggtgcatatatatttaggatagttagctcttcttgttgaattgatccctttaccattatttaatggccttccttgtctcttttgatctttgttggtttaaagtctgttttatccaagactaggattccaacccttgcctttttttgttttccatttgcttggtagatcttcctccatccctttattttgagcctatgtgtgtctctgcacgtgagatgggtttcctgagtacagcacactgatgggtcttgactctttatccagtttgccagtctgtgtcttttaattggagcatttagcccgttaacatttaaggttaatattgttatgtgtgaatttgatcctgtcattatgatgttagctggttattttgctcgttagttgatgcagtttcttcctagcctcgatggtctttacaatttggtatgtttttgcagtggctggtcccagttgttcctttccatgtttagtgcttccttcaggagctcttttagggcaggcctggtggtgacaaaatctctcagcatttgcttgtctgcgaaggattttatttcttcttcacttatgaagcttagtttgactggatatgaaattctgggttgaaaattcttttctttaagaatgttgaatattggcccccactctcttctggcttgtagaatttctgccaagagatcagctgttagtctgatgggcttccctttgtgggtaacccgacctttctctctggctgcccttaacattttttccttcatttcaactttggtgaatctgaccattatttgtcttggagttgcttttctcgaggagtatctttgtggcgttctctgtatttcctgaatctgaatgctggcctgccttgctagattggggaagttctcctggataatatcctacagagtgttttccaacttggttccattctccccgtcactttcaggtacaccaatcagacatagatttggtcttttcacatagtcccatatttcttggaggctttgttcatttctttttattcttttttctctatacttatcttctcgcttcatttcattcatttgatcttccatcactcataccttttcttcaagttgatcacgtcggctactgaggcttgtgcattcgtcacgtagttctcgtgctgtggttttcagctccatcaggtccttgaaggacttctctgcattggttattctagttagccatttgtctaatcttttttcaaggtttttaacttctttgtcatgggttcgaacttcctcctttagctcggagtagtttgatcgtctgaagccttctctcatcttgtcaaagtcattctccgtccagctttgctccattgctggtgaggagctgcgttcctttggaggaggagagctgctctgattgttagaattttcagtttttctgctctgttttttccccacctttgtggtttttatctacctttggtctttgatgatggtgacctacagatggggttttggtgtggatgtcttttctgtttgttagttttccttgtaacagtcaagacccttagctgcaggtatgttggagtttgctggaggtccactccagaccctgtttgcctgggtatcagcagcggaggctgcagatcaggggatattggtggacaccaaatgtcgctgcctgatcgttcctctggaaattttgtctcagaggagcacccggccgtgtgaggtgtcagtctgcccctcctggggggtgcctcccagttaggctactcaggggtcagggacccacttgaggaggcagtcttttcgttctcagatcttcagctgtgtgctgggagaaccactagtctcttcaaagttgtcagacagggacatttaagtctgcaggggtttctgctgccttttgtttggctatgccctgcccccagaggtggagtctacagaggcaggcaggtgtccttgagctgcggtgggctccacccagttcgagcttcccagcctctttgtttacctactcaagcctaggcaatggtgggcgcccctcccacagcctcattgctgccttgcagtttgatctcagactgctgtgctagcaataagcgaagctccatgggtgtaggaccctctgagccaggtgtgggatacaatcttctggtgtgccatttgctaagacctttggaaaagcgcagtattagggtcggagtgacccgattttccaggtgccgtctgtcacccctttccttggctaggaaggggaattctgtgaccccttccgcttcctgggtgaggcgatgcctcgccctgcttcggctcacgcttggtgcgctgcacacactgtcctgcacccactctctgacaatccccagtgagacgaacctggtacctcagttggaaatgcagaaatcatttgtcttctgcattgctcacgctgggagctgtagactggagctgttcctattcagccatcttggctccaccccctagaaactatttttcatctatcagattggtaacagtttttaggtgtagcaatatcaaatgttgacaagggtgcaagcaaagtactctcatacatagctggtaagagtggaatagcccctttggatgacaatttggcagtatctataaaaaaagaaaatgtatatcctcatgactctgtaattcccacttctttctaccctagtaaaaccttgcacatgtgcacagaaatcatgtagcagaatatttcattatggaaaaaaaatgaggcagatctgtatatgctgatataaataaatctccatgactaattaagttaaaaatggcaagttacagaataacatatatatatataaaattctatgtttaacacattttatttggtataaacacacacgtgtgtgtgtgtatatactatatacttacatcaattatatattctagtaatggatattatgtgatatgtaatatataatacatttgtttaatatataatcatgcaccaaataatgacatttcagtcagtgacagaccatggatacaatgatagtcccataagattgtaatactgtatttttactgtaccattatgtttagatacaaaataccattatgttataattgcccacagtattcagtacagtcatatgatgtacagtcacatgatatacagttttatagcctaggagcaataggctataccatatagcctgggtgtatagtaggctatactatatagatttgtataagtgcacactatcatgttcacacaatgatgaaattgcttaacaatgcgtttctcagaatgtattcctgttattaagtgacatatgactgtaaatgtctagatatgtaatatttgactatgtaaatgtctgcaaaaaatggaaggtatgcatcaagctgataacagtgcttacttctggagggggactggaattttggcagggttgaggcagtcaaggagacttgacctttacaagtattatctatttttttatataaatatatttatatgttacttctataagtaaaaatatagaatatatttttctataagtatagataaatatagaatatatgtaatatagaatatatgatatactatatatagaatatatgtaatatagaatatatcatatatattctgtatgtatagaatatagaataaatgtagaatatatcaaataaagaatatatgaatatacacatacatacatacacacccatgttattagtggttttaaatatgcagggtagtttgggcgtggtggctcatgcctataatcccaatactttgggaggccaagggaggtggatcacttaagctcaggagttcgagaccagcctggccaacatggtgaaaccctgtctctactaaaaatacaaaaattagccaagtgtggtggcaggtgcctgtaatctcagctacttgggagactggggcacaagaatcttttgaacctgggagacagaggttgcagtaagccgagatcacaccactgcactccagcctatgtgacagagcaagactctgtctcaaaaaaaaaaaaaaaaaagcaaggtaactataaagattgattttcattggttatactgaagtgactgagtacattgcttggaaaacagctctaggctatttagaaagcttctctgatatagccccacctaatctgcctctgcttattcgtgtcagtctaatactggtctagggcgtgcatataatcttcttggctgccaactactcatccagtcagttttcgccaatcttttttggttatgagaataggatggaatttgggttttccactgtcaaacttcagtttctagacttcgttttctttttttttttttccatttaaccctgagtggacacagcacatgtttcagagagcacagggttgggggtaaggtcacagatcaacaggataagaatttttcttagtacagaacaaaatgaaaagtctcccatgtctacctctttctacacagacacggcaaccatccgatttctcaatcttttccccacctttccccccgctctattccacaaaaccgccattgtcatcatggcccgttctcagtgagctgttgggtatacctcccagacggggtggtggccgggcagaagggctcctcacttcccagtaggggcggccgggcagaggcgccccttacctcccggacggggcagctggccgggcggggggctgacccccccacctccctcccggatggggcggctggccaggtggggggctgacccccctacctccctcccggacgggacggctggccgggcggggcctgacccccccacctccctcccggacggggcggctgctgggcggagacgctcctcacttcccagacggggtggctgccaggtggaggggctcctcacttctcagatggggcggctgccgggcggaggggctcctcacttctcagatggggcggctgccgggtggaggggctcctcacttctcagacggggcggttgccaggcggagggtctcctcacttctcagacggggtggccgggcagagacgctcctcacctcccagacggggtcacggccgggtagaggcgctcctcacatcccagatggggcggcagggcagaggcgctccccacatctcagacgatgggcggccaggcagagacgctcctcacttcctagatgggatggcggccgggaagaggcgctcctcacttcctagatgggatggcggccggcagagacgctcctcactttccagactgggcagccaggcagaggggctcctcacgtcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaaccagactccgtctgcaatcccggcacctcgggaggccgaggctggcggatcactcacggttaggagctggaggccagcccagccaacacagcgaaaccccgtctccaccaaaaaaatacgaaaaccagtcaggcgtggtggcgcgcgcctgcaatcgcaggcactaggcaggctgaggcaggagaatcaggcagggaggttgcagtgagccaagatggcagcagtacagtccagcttcggctcggcatcagagggagaccgtggaaagagagggagagggagaccgtggggagagggagacagagggagagggagagggagagggaaagggctagacttcgttttccaaatgcatgcagaactgcagttgttattgagtagataagtttgaaagttctgaatataagaatatttgtgcagctctttacagtttacaaaatgtctacctttttatcttatttgatcttcccaacaaccctgtgaggtaggtgttattattaattattgacatagatagggaaacctttgggagtccccaagagctcccctagatcaaatgattcactaggaggactcacaggactcagcatatagtcatactcacagttaagatttatggggctgggtgccatggctcacgcctataatcctagcactttaaggaggccaaggtgggaggatcgcttgagcccaggagtttaagaccagcctgggcaacatggcgaaaccccatcactacaaaaaaatacaaaaattagccaagttggtggcagactcctgtagtccttgctactcaggaggctaaggtgggaggatcacttgagcccgggagataaaggctgcagtgaaccatgatcatgcctctgtactccagcctaggtaagagtgagactctgtctcaaaagaaagaaagagacagacagagaaggagggggagaacggggagggagggaaaggaaaggaagaaggaagaagggaaggagggagggagggaaaagaaaagaaaaaaagaaagaaaataagcaaatgaagagccagatgtggtggcacacacctgtaatcctagcactttgggaggcagaggcaggaggatcacttgagcccaggagttcaagaccaacctgggcaacatatatatatacatgtgtgtgtatgtatatatatatatatatatatatatatatatacgtatatatatacatatatacgtgtatatatatacgtatatatatacatatatacgtgtatatatatacgtatatatatacatatatacgtgtatatatatacgtatatatatacatatatacgtgtatatatatacgtatatatatacacatatacgtgtatatatatacgtatatatatacatatatacgtgtatatatatatatacgtatatatacacatatatatacatatatacacatatacgtatatatatatacacacacatgtacacacacacacacacacatacacacacacacacacacacaaactcttttctgaacagaaaccaaaactaaaagatgaagtgactttccttaaagatacttatatagtaagcgtggcagtcaagattaaaacccagaccctcagattccaaacatttcctactacataattttaatctccatcaaatcaagagtaaatgttttcagcgtgcagttgaagtggtaaaaattaatgcatagttccttgagacatggaatgctgaagtgatttttcttcctgtgccatataatgtcttctttctctttgacctataacctttctaggataacataaaagagctagaattagaagtcatcaatctgcaaaaggaaaaggaagaattggttcttgaacttcagacagcaaagaaggatgccaaccaagccaagtaagaataaagttaataaatgttatttcaagtccctactatgtgtgaggagctttgcaagaaatagagaagtagaagtcccatttactgcccctaaagatttaaacctaattatgaagaggaaacctaaacacaaaaaatggttaaataattgcaattttaaatagcgtctcaagttgacagtaaaagaatgtcataacacagcacatgattagtagccaaataaatttcttaggcagtaattgtgttaagagttcagaggcgaggaatatcaattcaggctaccatgatcaaggaaggctttgtaaaaagttagcatttgagctggcttttgaaagattatcacacttactagataacagcagtttctttgtccctgcactaatggtaaattagcttgtgaatggaattaatgtccaggctagtgatttaaaaaatcaatctagccatctcttaccagttaagaataaaaccaaagcagataaccataacatcctactctccttcagacctctgccgtatgggctatcctaccttctttttactcagtgactccgttttatctctcagttgagtctaaagctcatgtttgtaaaagttatgctgaatgtttactttctatctcagacttgtataataatcatcagaattattcttcatagctaaagtgaagtgaaatgccttcaaagaaccattttgatgcaaaaggggcggcgtatattgaggcagttgcattgctgtgtactaaaagttgtcttactctttgtattaagctcctattattgagacaggtttggttgtttgggtggtattctttttttaagatggctatgtgactagtcacctattttatatatgtcagtgttgtaactctgggagtctagtattatgtcttttgaagtcaggctttgctgctggtagtcctcacttctacagcatctgtgtttaggttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacgggtaataaattctcatccttgcatttacccccattggaatttacaaacataggtattccatttagaaatatactagaggtgttttcaggtgagaaaatagcaggcagagcaatcatttcaagtgtgtgaatctccacaaatgtcccttttgcagaacattgtgctagtggtcatctaggatctgcttaataaaacgttgctttgacattcaaaatttaatgttagagtctctgaaaccaaagaacaaagacatctccatacttagtgggttatatcctgatcaccttccatgatcatgcagcataattttgtaaagtagtaataagatgacagacacctagagaaaattctcagttattgaatgttcaacttgtggcaccaacaaagtggtggttacaggctacttgtactgaaacctttagaatacaatggttactaggtggatttgtcctggaggcttagtagatgtttccttgaaatttcatttgtatacagtgaatttagggctggatttagcttgtaggtacatttttatttaatttcttctcagtgttcacttgtatagcctgtacttggaaaccctgtgcaagcatagcaaggggtattgtaagcctaatcagggaatctgttggggactgctttcccagcctagttctggcttttctctcttcttaatggtaagtctatccatccgcaccagcctagaataaactgcagatgactaatacttttgctggtttttgtttttatagatgatgaaaaaccagcgggtacagttaatgcgtcaaatgaaagaagatgctgagaagtttagacagtggaagcagaaaaaagacaaagaagtaatacagttaaaagaacgagtaagtaactaaaacttcttgaaggcctaggtaataaacccttctctgagctgactaacaattttaatgcttctcttcaaacacctcgtgtctccaaaagtgtgacattctcatgaatttaacaactttattaaatgtctactatgtctattatgtgcaaggtactatctactaggcactattagaaatagaaaaattagtagtatataagctctgcccttgaagaatgtcttacctaaaggagatggtaagatataagcatggatttctcaaatacaaggaagaaagagatttgggctataagaataaaataaaaagtaactaagagaaaagaaagcaaatttgcagttggagtgaaaagatgatggttgaataggccctgaataataggaagggttatgatagagataagtacaagcattccagatagatagatcaaagaaatagagatgacaactttgtagacacattcaaggaatggcaagtggtccaactggggtgaagtatagtagtggaccattccattggaaaggcaagtcgaagctggattattaaagatccaagaagtttgaactcattttgttagtagcataaagatttttaagggtttttagaaagtgatatcaacaaaatactgctttagaaagatatatctgggaataatgtatagagcaaactgtaatattgagaaacagaggccagaacacaagaagatattgtataatccagaagaattataagggcctgaatatacatctgacaacagagcccccagaatatatgaagcaaacactgacagaaatggagagagaaatagacaaatcaacagtaataaatatttggagacttcaatccacctctttattttctttcttttttagatatggggtcttgttctgttgcccaggctggagtacagtggtgcaatcatagctcactgtagcctcaaactgctggtctcaagcaatcctcccacctcagcctcctgagtagctagaactacagctgtacaccatcacacctggcaaattttttattttttgtagagatggaatctcactatgttgcccagactggtctcgaactcctgggctcaagcagtcctctcacctcggcctgctaaagtgctggtattacaggcatgagccactgaacccagcccctactttaataatggatagaacaataggcacaagatcagcaaggatattgaagacttcaacaatataatacctagcattttcatatctacattcataagagatattggtctataagtttatgtaatatgctagattacacactatacctaacagaatctatagactacgccaaccaacaacagcaggatatacagtcttcctaggtgcacatgaaacattctccaggatagaccatatgctagaccttttatgcctcaataaatttaaaagtattgaaacaggccatgcatggtggctcactcctgtaatcccaacactttgggaggccaaggtgggcagatcacctgatgtcaggagttcaagaccagtctggccaacatgatgaaacaccgtgtctattaaaaatacaaaaattagccgggcatggtggcacatctgtgatctccagtattcaggaggctgaggcaggagaattgcttgaacttgggagatggaggttgcagtgagctgagatcgtgccactgcactccagcctgtgcaacagagcaagactccgtctcaaagaaaaagtattgaaaataatacaaaatctgttctctaaccacaatggaatgaaattaaaaatcagtaacaaaaataaatttaggaaattcacaaatatgaagaaattaacataatcctaaataaataatgggtctaaaaggaagtcatagggaaattaaaaaatactttgagattaataaaaacaaagatacaacataccaaaacttatgagatacagctaaaacagtgtttggagggaattttatagttgtaaatgcctatattaaaaaatgcagaaaggctcctgtagccccagctacttgggaggctgaggtggaaggatcacttgaccccaggagttcaagaccagcctgggcaaaattgtgagactgcatctcagttttttttaattgaagaaagatcttaaaccaataacctagccttctactttaaaacactgaaaaaaagagagcaaactaaacccaaagctagtagatgaaaggaaacattaaaagattagagtagaaataggctgggcgcggtggctcaagcctgaaatcccagcattttgggaggccaaggtgagcagatcacctgaggtcgggagttcgagaccagcctgagtaacatggagaaaccctctctctaccaaaaatacaaaattagctgggcatggtggtgcatgcctgtagtcccagctacttgggaggctgaggcaggagaatcgcttgaacccgggaggtggaggttgcagtgagccgagatcgcaccattgcactccagcctgggcaacaaaagcgaaactgtctcaaaaaaaaaaaaggattaaagtagaaattaatgaaatatgaaatagaaaaaaacggggaaaatcattgaaaccaaaagttggttttttgaaatgatcaacaaatactgacaaaccttcagatagccttaataagaaaaaaaaagaggccaggcgcggtggctcacacctgtagtaatcccagcactttgggaggctgaggcaggcagatcacaaggtcaggagatcgagaccatcctggctaacacggtgaaaccccatctctactaaaaatacaaacaaaaaaaaattagccaggtgtagtggtgggtgcctgtagtcccagctactcaggagtttgagggaggagaatggtgtgaacccggaaggcggagcttgcagtgagcagagatcgcaccactgcactccagcctgggcaacagagcgagactccatctcaaaaaaaaaagaaaagaaaaaagaaaaaaaagaaagaaaatttaaattactaaagttaggaatgaaagagggaatatcactactagtcttgccggaaggaaaggattataaggaattactattaacaactgtatgccaacaaattagatagcctagattaagtagacaaatgcctggaaagacaaaaactaccaaaactgactcaagaagaaatagaaaatctgtatagacccatgacaagaagttaaattagtagtttaaaaacttcccacaaagaaaattccaggcacagatggcttcactggtgagttctatcaaacattttaagaaaaaatacccatttcttggccaggtgctgtggctcatgcctgtaatcccagcacttttggaggccgaggcaggcagatcacctgaggtcaggaattcgagaccagcctggccaacatggtgaaaccctgtctctactaaaagtacaaaaattatttgggtgtggtgacacacacttgtaatcccagctacttgggaggctgagacacaagaattgcttgaacccaggtggcgaaggttgcagtgagccaagatcacaccgctgcactccagcctgggcgatagagtgagattctgtctcagaaaaaaaaaaaaaaaagacagaaatacccatttctcagaaactcttctgaaaactagaagcagtggaaacacttcccaactcattccatgaggtttgtgttccctgataccaaaaccaaagacatcacaagaaaagaatactacagaccaatatatcttaatataggcatgaaaatcctcaacaaaattctagcaaactaaatccatcaacatttaaaaaggatgataggctgggcgtggtgactcacacctgtaatctcagcactttggaaagccgagatgggcagatcacttgaggtcagaagttttgagaccagcctggccaacatggcgaaaccctgtctctactgaaaatacaaaaaaaaattagctgagcatggtggcatgtgcctgtaatcccagctacttgggaggctgaggcacgagaattgcttgaacccaagaggaagaggctgcagtgagccaagaccgtgccactgcactccagcctgggcaacagagtgagacactgtctcaaaaaaaaaaaggatgatacacttatgaccaagtgaagtccatctgaaaaatgcaaagtttgtttaatatatggaaatcaatttatgttatatactgtatcagtaggaaaaaggacaagaaccacatgatcatctcaatagacacagaaaaagcatttgacaaaaatctaacactcatgataaaaacactcaagaaactaggaatagaagagaacttcctcagcgtaataaagggcgtgtatgaaaaacccacagctaacatcatacttaatggtgaaaaagagcatacttttcccctaagatcaagaacaagacaaggatgtccactcttgccatatctattcaacattgtcctggaggttctaaccaggaagtttagggaagaaaaatatataaatggcatctaaactggaaaaggtgaagcaagactatctctgtttatagatgacatgatcttgtatatagaaaatcctagagaatccactaaaagtctattagaattaatatatgagttcaccaaggttgcagaatataagatcaatataagaaaataagttgtgatctggcacagtggctcaagcctgtaatcctagcactttgggaggccaaggcaggcatatcacttgaggccaggagttcgagaccagcctggccaacacggtgaaaccccgtctctactaaaaatacaaacattagccaggcatggtagcacatgcctgtagtcccaactacttgagaggctgaggcacgagaatcatttgaacccaggaggcagaggtttcagtgagctgagatcaggccactgcacttcagcctgggctacagagcaagactctgtctcaaaaacaaacaaacaaaaaaaacaaaaggaaaagaaaagaaaatcagtagtatatttatatactagcaattaacaatttgacaatgagattaataaaacaatcccacggctgggtgtggtggctcacgcctgtaatcccagcactttgggaggctgaggtgggcagatcacaaggtaaggagctcgagaccagcctggccaacatagtgaaactccgtctctactaaaaatacaaaaaattagctgggtgtggtgacaggcacctgtaatcgcagctacttaggaggctgaggcaggagaatcacttgaacccgggaggtggaggttgcagtgagtcaagatcatgccactgcaccactccagcccaggcaacagtgcaagactctgtctcaagagaaaaaaagaaagaaaacaattccattaataataggatcaatacaaataaaatacttaggaataaatttagcaaaagaagtgtaagacttgtatacttgaaaactactgaacatcattgaatttaattaaggaagacttaaataaatggaaggatatcccatgttcatgggcaggaagacttgatattctaaagatggaatacccttcagattgccttacagatgcaacacaatcccagtgaaattccatctggtttcttcacagaaactcacaaactgattctaaaatatatatggaaatgcaagggacctagaatattcaaagcaatcaaggagaagaacaaatttgtaaatgtcacatttactgatttaaaaactttctacaaagctacactaatcaagactgtgtggtactgtgtaaagatagacatataggtcaatggaataagattgagaatccagaaataaacttacacacttatggccagttgattttcaacagtaatgccaagacaattcaatgaggaaaacaattttgtcttttcaacaaatagtcctagaacaaccgggtagtcatatgcaaaataatgaagttgaaacttgtggccaggcacagtggctcacgcctgtagtcccagcactgtgggatgccgaggcgggtggatcacttgaggtcaggagttcaagaccacctggccaacatggtgaaaccccgtctctactaaaattacaaaaaaattagctgggcatggtcgtacatgcctgtaatcccagctactctggaagctgaggcaggagaatcacttgaacctgggaggcagaggttgcagtgagctgagatcacgcccctgcactccagcctgggcaacagagtgagactctgtctcaaaaagaaacttgctctcataccatatacaaaaattaaagcagatcaaaaacctaaacgtacgagctaaaactataaatctcttagaagaaaacataggtgttaatctttgtgactttggattagacaatgatttcttagatgtgacacctaaagtacaaacagctaaccaaaaaagagttaaattagacaaaattaaaagcttttgcattgtaaacaataccatcaagaaagtgaatatgatcaggcatggtggctcatgcctgtaatctcaacactttgggaggccaaggtgggaggattgcttgagcccaggaaattgaccccaccctgggcaacatagcaagaccccatctctaacaaaaaaaaaaaaaaagaaagttaatagccagtccatagattgggaggaaaatatttgcaaatcatatagctgataagagtcttatatccaagatagataaagaactcttactgtctgggcacggtggctcacacctgtaatcccagcactttgggaggccaaggcgggcggatcacctgaggtcgggagttcgagaccagcctgaccaacacggagaaaccccgtctccactaaaaatgcaaaaaaagtggccgggtgtggtggcacatgcctgtaataccagctactggggaggctgaggtagaagaatcgcttgaatccgggaggtggaggttgtggtgagccgagatcgtgccattgcactccagcctgggcaatagagtgagactccatctcaaaaaaaaaaaaaaaagaactcttaccaatcaacaataaaaatataacccagttttaaaatgggcaaagcaataagtacatgaaaaggtgctcaatgtcatttgccatcagagaaatacaaatcaaaaccacaatgagatgcaatttcacatctactaggatggctataaacaaaaagacagataataataagtcttagcaagaatgtggagacactgaaagcctcatacattttcagtaggatgggaaaatggtatagctgctttggcaaacagtttagcagtttatcaaaaggctaaataaaaacgtagaggtaccatatgatccagcaattccactcttagttttgtctacccaggagatacgaaaacatgtcatatatgcaaaaccttgtacccagatgttcatgcagcagtagtcataatagccaaaaagtggaaaaacccaacatgtccatcaactgatgaatgggtaaataaaatgtggtctatccatacagtggagtattattcagccatacaaaggaatgaagtactgatacatgctacaacatggatgaggcttgaaagcattttgcttagtgaaagaagccaatcacaaaagaccatgtatgataggattccatttatatgaaatatccagagtaggacattaaaatctgtagagacaaaaagtagattagtggttctctagggctttggggtggggtgatggggttgtagggtgatcactaaacagtatatttctttttgtggtaatgaaaatgttctaaaattaagtgtggtgatgtttacatcaactgtgtgaatgtgccaaaagccattgaatcatgtactttaaatgagtgaattgtatggtatgtgaattatatctcaataaaactgttaagaaaaacaaaagaagaaaggagacatctctataaagtgatgacaactttacattctacaggaatatatattccacattgacaaggatctttgttttgctcacttctgcatttccaatggctagaacagtggctggcaagtagtgggcactcaataatgtttagtgaatgattttaatcataattaatgcaaaatatacctttcaaaaaatgaaggaagtagggcaacaaaaagtaccgcgggcttttcagtgactgtaaagtcagaggaaacagctagtttgaagagacaaagttggttttaggagaataatctttgggatggagagacctagaaaatattggataatgttggcctagagttcaagggagaagttgggctggactttgcaattaagagttgtctttgtgaggccaaggtgggtggatcacgaggtcaggagttcgagaccagcctgaccaacatgctgaaaccccatctctactaaaaatacaaaaaaaattagccaggcacggtggcacatgcctgtaatcccagctactcaggaggctgaggcaggagaatcgcttgaacccgggaggtggaggttgcagtgagcagagatcgagccactgcactacagcctgggcgacagagggagactccgtctcaaaaaaagatttgtctgcatagaggtgaaaaatgaaactttgggagtaatgagataatggagacagagaatatatagaaaaagaaggctaagaagagaatctctttttttttttttttggtctcaccctgtcatccaggctggagtacaatggcaccatcttggctcactgcaacatctgcctcctgggttcaagcctcctgagtagctgggactacaggcgcatgccaccatgcctggcaatttttttttgtatttttagtagagacagagtttcgccatgttggccaggctggtcttgaactcctgacctcagatgatccacccaccccagcctctcaaaatgctgggattacaggcatgagctaccatgcccaactgagaatctatttcatgtataagaaaatgaaaagaagacaatgaaatttgtaaggtagaaaaataattaggatggtatggggaagttattggtagtgctaacgatgctgggagagaagccaaagaagatagtgactgtaaaaacaccactgaatttaagaagtaggaaattccaggacaactggtaggaactacttacaaggggattatggagtgaccagtaatgacaattggaagcactaaacatagacctctctttcaaaaagtctggtactaagaagactgttgacttttctctttccactggactagcttagtcctctgactgtgtttctttaattatcttgacttttcatttcaacacacatcatattttattataattgtattgcatgttgtttgtattctctggtaatctctgtaggagtagtaaccatgtcatgtttatctctgtatcctagacacctagcccagtgcctagtgtttagttgatggcacagtaaatattatattgttgaatgaaatgaattgttctagtatgctggcaaagacatgacaaaaatggctgaccattctatccagattggattggaacaagtgaagccagaaggagcttaatggattattagaagagggaaatggccaagaaatcaaagcagttaaatattgtgtgctcagctgaagcaggtgataccccatagtatttcttggtattctttatctttaatctctgggaagaaagagcacattcagtaataacctgtttttatttttattttagattcagtgggtgcaggagcaggtttgttacaagggtatattgtatgatgctgagctttgggcttctactgatcccatcacccagatagtgaacatagtacccaataggaagtttttcagctcttgcccccctttctccatccctccctccttttagagcccccaatgtctattgtttccatctttatgtccgtgtgtacccaggttaaccttgtttttttcaaaaatgagaaacctcttttttttttagctgcaggttactttaattttataggtggttggctatgtgatagactttctcttttttgccagccacctgggttttgtaatggatggacaggtagggttgatgggaaaagaatactggtctatttttcaggagacctgaatcccacctctgtcaataactacctatgtggaaaggactgttcattagatgatctttaagcttccttccaggcctcacattctaggatattatttctagtagttgatttatgactgagactcaagaatttggccacagagcaataagccaaagggaaaaaccacttcccctctacacacaaacatggtttctagaactacgagtttttgactcatatgagaagatgaaggcagctcactgtattgtagttaaccttacaaatcaaggatgtcttgagagacaccttatagtataaggttttattttagctagctgaacagcaattaatatctgacttttttcttgtcaggaccgtaagaggcaatatgagctgctgaaacttgaaagaaacttccagaaacaatccaatgtgctcagacgtaaaacggaggaggtaagaaaattcaatctgctaggtcaagtgtattgtcatcttcaggtttaaatgcttgcaaagtaatatcctttaaactagcaagcgtcctgagaaaccagggatgccaatcttcacaagcaattcctaaatcttgatcactgtttatatgccactgtgagcagataaaaacttgatgaaaaatggtactgttcaaataaggattttttcctaactggacgtgagcctttcctgaaaaaacaaagtgatattgatatgtgacatttctagacacttttagtctgcagaacttccttgaagtgtgttcctcccctaggcaccaaagcagtagctgttcaccagtgttatgtccatggaagtttataaacctggttcctataggaactcaaacccatagaatttttatctttactaatgtgctagaaattggattttttttttttaccattcattcaacattactatgtgccaattttatttaggcagcagctgccaacaagcgtctcaaggatgctctccagaaacaacgggaggttgcagataagcggaaagagactcagagccgtggaatggaaggcactgcagctcgagtgaaggtatgaacaacttgaactgccatttctcttgtggacactgggaacaggaaaaaaggagaaatagctttttttttttcctttttttagaagtaaacactgcaaaatctaaagttctacttgaaagccttatttcctaaagatagcaatgtctttgaactgttgttaaagaccaggagtatagaactctttctatctttgcccctattgaggttcagttacttttttaaacagcttcattgaagtagaattgacatattataaattgtacatatttaaagttcacaatttggccgggcatggtggctcacacctataatcccagcacattgggaggccgaggtgggcagatcacctgcggtcaggagtttgagaccagcctgaccaacatggtgaaacctcatctctactaaaaatacaaaaattagctggttgtggtgacaggtgcctgtaatcccagctacttgggaggctgagggaggagaatcgtttgaacctgggaggtggacgttgcagtaagccaagatcgcaccattgcactccaaactgggtgacagtgaaactctgtctcaaaaagaaaaaaaagtatacaatttgatgagtttggacacgtgtatacacccatgaaatcatcaccataatcaagataatgacagtgtgcttcattgcctaaactttctttgtatccctctgtaatcccttcttcttatccctctgtaatcccttcttctcctccctggtctacccgtctactccccatttcatatatatttctttatatccccacagtggttccaggcaaccattaatctgctttctgtcactatggatttgttttcatctggaatcatacattatgtattttttttctggcttttattcacaattattttgagattcatccatgtggttgcatatgtcatatacaacttctttcctttttattgctgagtggcatcccattcattgtatggctataccataatttgtttttatatccatctgttgatggatacttgagtggtttccagtttttggctcttacaaatattgcactgaacatttgtgcacaagcctgtgtggattttttttaatttcttttgagtagatagctaggagtaaaatggctttcttgtatggttggtgtatgttttaactgctaagtggctgccaaactgttttccaaagcagttgtaccattttacattcctactagcaatgtataagggttctagttgctacacattcttgccaataattagtatggtcagtcttttgaattttagctattctgtgtgggtgggtagtggaacctcattgtggttctaattttcttttctgtaatgactaatgatgttggacatcctttcatgtgcttatttgccatatgtatgttttcttttgtgaaatatgtgttcaaatctgtccccatttttaaattgggttgtttatctttttcttattattgaattaaaattctttatatattctagatatatttaacagaggacttctgtgttttacaaatattttctccctggctgtggcttgcccttttcaatttgtaacagtgtcttttgaagagcaaacatttattatgttaatgccatccaatttattgatatttttttctttatacttaaacagttttcatatcttgcttaagaaatcttggctgggtgtagtggctcatgcctataatcccagcactttgggaggctgaggcaggaggattgcttgaggccaggagttcaagaccagcctggggagcaaagtaagatcctgtctctacaaaacaaaattttaaaaaaattaaccagacatggtggtgcatgcctgtagtcccaactaccggggagactgaggtgggaagatcgcttgagactgggaggtcaaggctacagcaagccatgatcgcaccactgcactccagcctgggtgacacagcaagatcctgtctcaaaaaaatttaaaacagaaatatttgtctggccaggctcagtggctcatgcctgtaatcccagcactttgggaggccaaggcgggtggattacctgaggtcaggagttcaagaccatcctggccaacatggcaaaaccccgtctctactaaaaatacaaaaaattagttgtgcacggtggtgtgcgcctgtagtcccagctactcgggaggctgaagtggaagaatcgcttgaaccggggaggcagaggttgcagtgagccgagatcgttccactgcactccacctgggtgatagagcgaggcttcgtctcaaaaaaatatatatatttgtcaaacccatggtcgctaagatttccccctaagttttcttctagaagttacatatttttaagctttacatttacgtctttgattcattttgactggacacctttgtcaaaattaaatatccatacatctatttcagattgtttcattgatctatatgtctatttttatgccaataccaaaaagtcttgaatgcagttgctttttaagaaatcctgaaatcagtgtaagtccaaagttgttgttctttgtcaaaattgttttgggaaaactgggtcctttgcatttccatatacattttagaattatcttgttaatttctacaaaacagcttgctgggagttggattaagattgcatagaatttacaaatcaattcaaggagaatcaacatgttaagaatatttagatacacgaatgcagtatatctctttatttaggtttttaatttctctcagcaacattttagtttttagtgtacaagcgttgtacatcttttgtcaaacatatccctgagtatttcatatttttatgatattgaaaatggcatttttatttccatttccaattgtttagatattcttgttggttctcaaagcttttttgtagagttcttaagattttctacctagaaaatcatgtcatctgcaaatatggacaattttatttcttcttttctgttctgtgcttttttatttttttaacctttgtcttgccttattgcacttgctagaacctccagtacaatattgaatagactaggtgagaggctacaaccttgctttgttcccagtcttgggcagaaagcattcagtttttcaccgtaaagtatgataatagctatagattttttggtatatgtcttttatcaggttgaagaagttcctttttttagcttgcgaagtttttattacaaattgatgttgggttttttcaggagcttttttttctgtttctgttgagatgatctgactgttggttgattggtcagtttttattctgttatatggcaaatggcactgatttttccctaatttattctgtcaaggcatagctgacatacaataaaataaacccttttgttgtatagttctatgtgttttgacaacatgtacagttgtgtgaccactacaacaatcaagatacagaatagttctcttatccccagaaactcccctatatctcttacagccaattcctcccacaaccctggcccttgacaaacactgatctgtactctgtcattattgttttccctttccatcagtgtcatagaaatagaaacatacagtatgacttccttcacttagcataattcgagattaatttgtgttgtttgtgtatctgtagtttgcgtgtttttgttgttgttgttgagtagtatttcattgtatggatataccacagtttgtttatccattcacctgttgaaggatatcttaggtttttcttttccttaggttttggcaattacgaataaagctgctgttaaaaacacatacacgtttctatgtaaactaattatttcacttgggtaaatacctaagagtgggactactgggtcatatgataagtatatgcttaatttgtaagaaactgccaaattgtttatccagttagttgtttattgctgatatatagaaatacaatttatttttgtatattaacttttatctcatgcctttattattctactagctcttttataggtttttaggattttctatgtagactatcatgctgtctgtaaatacaattttatttcttcctttctaatctgtatgtctatcatttctcctacttgccctattgcattggtgagaaccttcaggatgatgatgaataggagtggtgagaatagacatccttctgttcttcctgatcttagggggaaagcattcagtctttcaccattaagtatattaactgtagttaatttttttgaaatactttttgtctctagttagttgatttggtgaattattttgattgatgttcaaatatggaaccaaccttgcatttcttttttttttctttccgacttttactaggttcaaggattacatgtgcaggtttgtttttacatgggtaaatggcatgtttcaggggtttcgtatacagataattttgtcacacagataatcagcatgatacccaataggtagtttctcagtcctcaccctcctcccaccctccaccctcaagtaggccctggtgcctattgttcccttctttctgtccatgtgtactcaatgtttagctcccacttagaagtgagaacgtgtggtatttgattttctgttcctgcattaattctcttaggataatagcctccagttgcattcatgttactacaaaggatgtgattttgttcttttttttatggctgtgtaatattccattccaaccttgcatttcttggataaactccatttaattgtgatatatcatcctttttatgtattattaaattcagtaatacataaaaaaacttgtttaaatttttgtatctgtgttcatgagggatattggtgtgtagttttttgtaataccttggtctggttttgatatcaaggtaatactggcctcagaaagagctgggaagtgtagtcgtttctcttcaaatgtctggaagattttgtgcagaattaatattgtttctttcttaaaaatttgatagaattcatcaggaaagccatctgtggctggagagatttatgtttcttgcttagttttgctttttggggagagggatgttaaataaagttttaaaaatagatataggattgttcaaagttatatgtttctccttgagtaagctttggtagtttgtgtgtttcagagaacttgtctgtttcatctaagttgtcaaatgtattggcataaagttgttcatcatattcccttatcgttctaatatctgtaaaatctcagccaggtgcgattgtttatgcctgtaatattggcacttagagaagctgagatgggaggatcacttgagcccaggaattcgagaccagcctgggcaacatagcaagaacacatctctattttttttttaaatctgtaatgatgtcatctatctcattcctgtttgtatgttttctcctttttctcaatcagtccaactagaggtttatcaaagaaccaactcattcttataataggtaaaatggtaatttttatgttatatatattttaccacaataaaaaaattcaaaacaactcccaattcattaatttccactctgatcttataataataataataataataattattattattattattttgagacggagtctcgctctgtcacccaggctggagtgcagtggcgtgatcttggctcactgcaagctccgcctcctggatcttttttttttttacttctgcatactttggatttattttggtcttctttttttacttaaggaagaagctaaggtcattgatttctttcttttctaatataggcattcagtgctataagtttccccttaagtattcctttaacaacatcccacaaattttcataatgttatattttcactttcattcaattcaaaatacattctaattttcttattgatttttttctttgacccatgggttatttagaagtgttatgtagtttccaaatgtttggggatttttccaaatgtctttttgttattgatttccaatttaattctaatatggtcagagaacatacttcatatgacttgaatccttttgaacttattgagacttattttatggcccagagtatgatcaatcttagtaaatgttctatgtgtacttgagaagaatgggtattctgctgttgttggatggagtatctataaatgtcaatcatgtcaatttgattgattgtgctgttaacatctattgtgtccttgctgattttctgcatactcgtcctatcaattattgagaaataggtattgaaatcaccaactataattatggattttttccttagagttctacatttaggattaattgatccctgtattattatgaaatggacttctttattcttggtaatattctttgttctttgttctaatatctactttgtatgatattactgtagcccctccaactttctttttattaatgttagtatgttgtttttttttttgtcatggtgtatttaatgttaacgtatttgtgccttcatttttaaggtgtgtttcttttcttttcttttctctttctttctttctttctttctttctttctttctttctttctttctttctttctttctttctttctttcttttttttttttttttgacaagatcttgctctgttgcccaggctgaagtgcagtagcacagtcacagctcactgtagccttaacctcttgggctcaaatgattctactacttcatcctcccaagtagctcagattacaggcacatgccactacgcctggctaatttttgtattttttgtagagatggggtttcaacatgttgctcaggctggtctcaaactcctggggtcaagtgatccacctgcctcagcctcccaaagtgttgggattacaggtgtgagctaccacacccagccaaggtgtggttcttataggcagcatatatttgggtctagctttttttttttttccatagacaggatctcactctgttacccaggctggagtgcagtggcgtgaccatagttcactgtaacctcggatacctggactcaagtgattctcccatctcagtctcccgactagctgagactacattcatataccaccatacctggctaatttttctactttttgtagagacagggtctcactatgttgctcaggctggtcttgaactatgggcctgaagtgatcctcccaaagtgctgggactacaggtgtgagccactgtgcccagccatgtctagcttttttaatccaatctgaaaatctctacaacttaattggggtgtttagaccatttacatttaatgtgattattgatacaggtaggtttgagctatcatcttgctatttgttttctattgtgtcatctgttcttcattttctttttccctgctttttccttttttggatcagttgaacatttttatgatttatattatctttgtttacttgtacatgattttgtttcatgtattttggtgctttgttattagggacgtacacattaaggattatattctattgaacaatcggctcctttatcatgaatcctttttatccctagttttattttttgataggaattctactccatctgattctaatataatcactctggctttcttttgattactattagcatggtataccttcattaaaagcagaaatattctcagggatagttactgtttcaaaaagtgaattttggctgggcatggtggctcacacctgtaatcccagcactttgggaggccaaggtgggtggatcacttgaggccagcagttcaagaccagcctggccaacatggtgaaaccccatctgtactaaaaatacaaaaattagccaggcgtggtggcgcgtgcttgtaatcccagctacttgggtggctgaggcacaagaattgcttgaacctgggaggcagaggttgcagtgagccgagatcacgccactgcactccagcctgggcgacagagcgacaccctgtctaaataaataaataaaaagtgaatttactgaattttgtttccttttttaaaaatcccgttcatctactttaaaaattaaaaatggatatttatttattaaatagaatagatcataaaatattcaattttttattatgttaagggcaaaggaaaaaaatgaagaaaataaagaacagggcacatagaaatactaggaatctggagaaagattttctggagaaagcctctttcttgtgaccttttggcatgttgctgttaaaggctcttcgagaggtactgacatttttggtaagtgtaggtatgaatggatatcacacttgtagttacttgggctctggtccaaatgaagttaagtctggagctgaatctagcccatgagctagtgattcctcatccctaacacagacatcactgatttctcttccagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccgggtaagtacgcttatgaaaaaatgttgccaataatcagactctacattccccagaaatcctcatagctttggaggattactttccttttagtatttcacccttgttctcactattatttacagaggcgtacattctcccttactgaagtgcgtggtcaagtttcggagtcagaagattctattacaaagcagattgaaagcctagagactgaaatggaattcaggtaacagggactatctctaagccattataaaaatttatgcctggaatcaaaaattgaacctattaatctagtgattcaaaagccttgtgatggtggaaaaacacgagaaaataacaattttttttaaaccagacactgtactaggtatcttagatacattttcttattcaatccctttgatgccttatgaggtaagtatcattcttctcatgttagagatctaaaattaacttggtcatatggaagtgggttatcagaacttattaacattagtgtcactgaagttggtatacaaccccctcgctgctaaatttgactggctttttaataaataactggttaattggttaatttttaaaaggaaattcagcaatcttaagaaatttgccaaaggtaattaactggctaacaaacaacagagctgggattcaaaacacactctaattccaaagcccatgctttttacaatacagcacaattttttctctttatttttttaactgataactagagagtcaggcaccataatttttgatgcagtagtgtctctaagatgtagaaccaataacagaattttagaggaaccaaagaaatgataatagaagagcaacaacacagaaggtgaactttagagatcatcaagaaaatagttctaacatggtaagtaaagttgtcatgagcattaaatgaaattagtaaagtgcataacagtacttagcatattagaagtgctcaatgggccaggcgcagtggctcatgcctgtaatcccagcattttgggaggctgaggtgggtggatcgcctgaggccaggagttcaagaccagcctggccaacatggtgaaaccctttctctactaaaaatacaaaagaaattaggtgggcatggtggcaggcacctgtaatcccagctactcgggaggctgaggcagaagaatcgcttcaacccgggaggcagaagttgcagtgagccgagattgcgccattgcactccagcctgggcgatagagcaagactccatctcaaaaaagtaaaaaaatggccaggcacggtagctctcgcctgtaatcccagcactttgggaggccaaggcaggcagatcacgaggtcaggagatcgagaccatcctggctaacacagtgaaaccccatctctactaaaaatacaaaaaattagccaggcgtggtggcacgcgcctgtagtcccagctactcgggaggctgaggcaggagaatcacttgaacccaggaggcggaggttgcagtgagccgagatcgtgccactgcactcctgggcgacagagtgagattctgtctcaaaaatgaaaggcagacagacagaaagaaaggaaaggaaaggaaaggaaggaaaaagaaagagaaaagaaagaaaagaaaaagaaggaatagaagtgctcagtgaaggccgcactttctcaggacctcttgagactgtgttccctgtgccgtggtcactcatattggctctaaaaagtaaaaagaaaaagaagtggtcaatgaatgttcttctgtccctcatctcctagctctagaccagaaattatgctacacaggctcttctaatcatgattattttaagcagtttatgaaatctagaaggaacagaaccttgacagagattttatcgtgttttaggataatagaaccttgggatcatttaatctggttttagcaatacatactaactttatcttgggatacatctataaatcactcaacctttgagttcctgctttgtgctacactggatgcagttgggatatacagaaaaaatagatgacattgcccttgctctcaggtggaaatagtatcattactcacactggtgtcctggaatcatttgctaaaatttcaagaatgttgtaaaccgttgttagtttacaattgattatggtgagaatttttacaccacagaaactgacaaaagttacaaatcagggctggggtttttgtttgtttgtttgtttttgttttatgtttgtttgttttgagacaaagtctcactcttgcccaggctggagtacaatggcgcgatcttggctcactgcagcctctgcctcctgggttcaagtgattctcatgtctcagcctcccaagtagctggaattacaggcacatggcaccatgcctggctaatttttgtatttttagtagagacagggtttcaccatgttggccagggtggtctcgaactcctggcctcaagcgatcggcctgccttggcctcccaaagttccaggattacaggtgtgagccattgtgcccagccaagggctggctttttaagtgctggttattaaaaatttacctacataccatatgcgtaagtaaatgattatgtaaatgtagggctggtgccaagtagaaggaattagaggtgagtttagttaggagaatttttttagaactgatgagacttaaactacattttggaatagataagggacacgaattgtcagagaagacaggaaagggccaatgataggtgacaactctgaagtgttgtgccccacctcttccagaagccttccctgactttttaatccctcactaatcttccttgttctctaaactctttcagaacttatgatactcaattatgacatactgctgacatgttatctttatgtttattgttttatgtttattaattttgtcattctaaagacagactgtaagcttgttgaaggaaaggactctacattagaccagggttttcaaagtgtgggccgcagattactggggagctcatgagccagtgatcaaaactattttcataataatattaaggcattatttgccttttttgctacattggaatttgcactgaaaatgcaaaagccatagtgggctaaagtgctgacaccctaggctgaatgaaagcagtggcaccaacctgaactagtagtcattgtatgcttcaccactatatactctcaggttttaaaaaaacaagccagtcttaattaagaatggtgttgcgaaagcagtaaaagttgttgattttactaaatctggaccctggagttcatgtctgtgttacatcctgtgtgacgaaacaggaagaacacagaaagcacttctactgcatgctgaatatgatggtcgtctcaagaaaagcactgcgattgtttgaggtgtgagctcaataggcctcttttttcatgggacatcatttttacttaaatgaacaactgacagacaaactgtggttattaagacttggttacttggcagacattttctcaaaaagaatagagcgagcctgttgctttaaggaaaacagctgacagtgtttgttacctaagacaaaatgtgagctttcaagcaaaatttggatttggaaaacttgtatctgccactgtgaacttgacagtttttcataacttttctgataagaccagtagtgatattaacaagtgtgattttaaaaatatatattttatagaatgaaatgtgttaacatttggaagatctgcatgactctggagtaatattgtccaaatggcactttatagaatgatgtattcgtaaatgagccattcagattgcaagatagactgatgaattttaatatgagagaatataaaaaagtttatggaaatcatcattctcagtaaactatcgcaaggacaaaaaaccaaacaccgcatgttctcactcataggtgggaactgaacaatgagaacacatggacagaggaagaggaacatcacactctggggactgttgtggggtggggggaggggggagggatagcattaggagatatacctaatgctaaatgatgagttactgggtgcagcacaccagcatggcacatgtatacatatgtaacctgcacattgtgcacatgtaccctaaaacttaaagtataataataataaaataaaaacaacaacaacaacaacaaagtttattaataagtttcagattcaacattgcaactaactcttttttttttttattatactttaagttttagggtacatgtgcacattgtgcaggttagttacatatgtatacatgtgccgtgctggtgcgctgcacccactaactcatcatctagcattaggtatatctcccaatgctatccctccccccttcccccaccccacaacagtccccagagtgtgatattccccttcctgtgtccatgtgatctcattgttcaattcccacctatgagtgagaatatgcggtgtttggtttttttgttcttgcgatagtttactgagaatgatgatttccaatttcatccatgtccctacaaaggatgtgaactcatcattttttatggctgcatagtattccatggtgtatatgtgccacattttcttaatccagtctatcattgttggacatttgggttgcaactaactcttaaggaggtaccgcttgttgagttttagtgtagtctcaaagaagactatttgcagttatctgaaaaggctattaaaatactccttttcccatctgcatattcatgtgaggccagattgtcttcatttacatcaactagaacaacatgtcacaaaagattgcatacagagggagacataagaatccagctgtcttcaactaagccagacattacagagatttgcaaaagtgtaaaataattccttttcttactatttattatctcagaaaatgctacttttcagaaaatatgtaatgtataataggtttatgttttttttttgtttttgtttttttgacagagtctcactctgtcacccaagctggagtgcaatgacgtgatctcggctcactgcaacctccacctcttgggttcaagcaattctcctgcctcagcctcccaagtagctgggattacaggcacctgccaccaggcccagctaattttttgtatttttagtagatacggggtttcaccatgttggccaggctggtctcgctcctgacctcaggtgatccacctgcctcagcctcccaaagtgctgggattacgggagtgagccaccgcgccccgccaataggtttatgatttttttttttttttttttgagatggagtcttgctctgtcgccaggctggagtgcagtggcacaatctcagctcgctgcaacctccgacttgctggttcaagcaattctcctgtctcagcctcccaagtagctggaattacaggcacacgccaccacccctaactaatttttgtatttttagtagagacagggtttcaccatgttggccaggatggtctcgatctcctgacctcataatttgcctgcctcggcctcccaaagtgctgggattgcaggcgtgaactacctcgcccagcctaggtttatgatttttaagtgaattaattttttttttttttgagatggagtattgctctgtctcccaggctggagtgcaatggcacgatctcggctcactgcaacccccacctcccgggttcaagtgattttcctgcctcagcctcccaagtagctgggattacaggcacccaccaccacgcctggctaatttttgtatttttagtagagccggggtttcaccaggttggccaggctggtctcgaactcctgacctcaggtgatccacccacctcggcctcccaaagtgctgggattacaggtgtgagccactgcgcccagctaaaatttttttcagttgtactttctaatactataaatctctataggtataacacatgtgaacagaatgtcctagatgtcttcaataatttttaagggtgtaaaggggtcctgaaaccccaaaatttgagaactacagtcttagattattttcatacccatcttccttatagtaccaaacttatcactgcatatgaagcacatgctggtatactctttctcactagacacagaagaaatttgagaagaaagctattaattaaactgaaatactgtgtagattttggtctaggacatacttgatcagaaagtacccagaagctataaccagggtcagaatatctagtcttcttagaaacttctcggtcttgtggcaggcacatcaagataacctctcacaatgccagccatgggtatcattttggtacttgattgtagtaaagagcatatctacctgttcttttgagctttttccttcaagtctccaacctgaatcttatccttgcatgggtggaccatcatgtcacagtctgagcttatatggcctcaagacaaagtaacatattatacttaatccactacaacaaaagccttactgtgataagtctttccaagtcccactttatgacccatttatttcaaccagtatttaatggaataaaaccatttaaatagtctcttagagtccctttgttacaagatttgcgatactatgtaaaatcctaaccagatgacttaaacattatttaaatgatatttaactgatagctccatccataaaattatttgaagtttctcctcagagctcttcccccttcttgatgttcaggctacttgcaataaggcttactgtttctttccctgaaggagtgctcagattgctgacctacagcagaagctgctggatgcagaaagtgaagacagaccaaaacaacgctgggagaatattgccaccattctggaagccaagtgtgccctgaaatatttgattggagaggtaaacatcactctaaccagcagttaggaggctggctgtgtaggttgaaatgggatgttagccttgaaatattgtcaaagtgttattgccacttttcatggtagaaaccctaataacactaacattagagagtttagtagataaaggttggtgtaagcaagtacaggccagtcacttacaaaaatataatatgactcacaaattgatgcccgttgtgactggcctatagcaagtgctgaatgcgtgttagctgttgttattaggaaagaccagaatgccatagtgggtcactggctaaacatcaactgttatactgtactactttttaaaacccctatgagatgtatattcaaaaatttaagatccagtctagaaaagggaaaacctaagcatcttttgacatataaagattcattttagggaaaagccatctttgctgaccttaaaatgatatgtcaccttacgttgtcacaagaggaatgaaaattgattgcctctggtgattgaagcattttcactcaagataagcatacaaactccaaacccacaagtttaaacaatgctaccctttatacatttttgtgttagcttagcagatttgttctactaaggaaatcttgatcagtcttgtgaacactggtacttatgatgttcaccatctgggctagtagtgaatgtaaaactaggccagtgtaggatatgtagcctgaagagccagatctgcagtctcagtctacaagttctaacatgtgaatatagacattctgaaatgggacataattggccataagggtgtgtcctgtggattttgcttaaaaattaaggaagaacttcttaaatatcagaatttgtaattgtcagatactattcgggttagctttattcttgccttgaggcagagcaagaaataaaatggccttagcagtggcttctagccccaagatacatgtctcagcagaaatgtggactcttggcctgggaatagaacaatagtatatttactattcaatgttggaatccatatgacatgaaaaaataagaatagacttgaacatggaggaatttttctcagaccctttcaagaaagctgacattatcctgcctgttgaaagggggaaagaaaggtggtcattcttcaaataaactgatcttcttttattccttccagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtaaactctagcaagtcaagaagctatactgtgaaactatcattgccttgtattgttagttttaaaaaaaaagtggggatatgaaatttctttcaaaagtccacgtggccttttctaaattttgcaaataaaaagaaacctgaagcagagacgtgacttgtctaactttatacataccagtgacaatggctctgggtttccaacttaaatatgaatattaacaatattaacatgctgagaaacaggcccagcgtggtggctcgtgcctgtaatcccagcactttgggaggccaaggcaggcagattgcttgagtccaggagagtgaaaccccatctctacaaaaaattacaggaaattagctgagtgtgatggtgtgcacctgtgatcccagccactcataaggctgaagtgggagaatcgcttgaacccgtgaggcagaggttgctgtgagccatgatcgtgccattgcactgcagcctgggcaacagaaagaaaaaaaaaaactatgctgagaaacatccatgctgtacttactacttcatgccatgacagcaaatgagaacagtttacttctaaatcacaagagagcagtcacctggatcactgcttgaactaagtcaaaatttctttttccccttggtacctttgttaccacccattggatcgtgtctttctctaggtgctgtaccttctcagccagctgcagcaaagccaaatggcagagaagcagttagaggaatcagtcagtgaaaaggaacagcagctgctgagcacactgaagtgtcaggtatgatcacgagaggtctccagagatgagtttcacagtactaactgagaatcttgtctcatttagacccttgtacttgcagcagagagtaattaactactggaaaaagtatttataatggtagcctctactgcttttaggccctatttgatcaggttaggggtgcttagagtgtagccatatataggaataacctcattttgggtaccaaaatggcagcacatactccatatcagactctgaggccttgtggttcttggcgtcaaccctgagctctaaagagttgaggaagtgaaatcatccagtagttacttagaatcctagggccattcaaatggtatgaagagcttgttcttctgtgctgagacctgacatatttgtaaaatgcctggggtctgaatttcttccagaggctaggaacaccacaccctttagtggcatgttgtagcactattttagtctaacttagaatctttttcctgaaccaccagtctgtagggtttccttggcaccttccatctaagacataagcaaactagttaaggttgtatgcatgaatctgggtgtcttaggtgccaggtagttcggtcaggcttactaaagtagcaagtaaactgcctagtctatgttgagaagggtaaagagaagcatctatagacttcaagaaaatagagctaagtttctgcgggtttcttaatcagcatccgaatgtgaataagggatatgaagctaaggaatggaaaagaataaggaaggcttgtcgggcagagtccacggttcctatgaatgtggtcagagctgctggggagcattggaatggaagtggcattcagggcacctaggaactgggaatcagacatttttctgggtgccagtgcctgctgtgcaaaaaccatctgctgccagcaacttggcagcagtatgttttcatctatgtgagttgtttggtaacccacatgtagtgcccaaaataaccccatatatcactgcactatctggaaataggatgaagaacttgagaaaatgcgagaagtgtgtgagcaaaatcagcagcttctccgagagaatgaaatcatcaagcaggtaatacagtttcccacccacttgataagccctaagagaccccgttgctactgaggccagctcttgggaccaacccccattgtggtgacttggctttatttcatgaggtctacatttagtttccatgtgacatatgcatttcaaagtggaataaacataagtttttaaatttgccattttctgaatctaatattgttgatattggaaagtgggagtcaacgtactctactataatcctgcatcactttactatggtttaacgttaagctagcctaggtctggtatctgttttagccatgaacactcccagaagctgccctgcattatatactttgtctcttcttttcaaatagaaactgaccctcctccaggtagccagcagacagaaacatcttcctaaggatacccttctatctccagactcttcttttgaatatgtcccacctaaggtaaaatgatcagtgcctgtgatacctttgcacagcttaggtttggggtgagtgtgctaaaattgccctttataagaggttgacagttaaaattcccaaattctagcatctcacttttctttggagtcccagataaaactacagttcaatcctaaggaaagtaggcattcttactcctcagaaggctgactttgggccatggacaggcattacctaacacaactgaggaggagggacaggagaaaagagcaataatgttcagctgtccatccaaagatacttatctcatcatatcatgagtttccctttcctccctcagattggtcagcctccaatttcactgccttcaaagactctgcaaagccataggctaaagcagaatttcttctgattggtaaagccaagtggggtggatttgagagagtctgaaatctttgctctgagaatatagctggcaacagctactgggaagatatgatgcatatatagtttttagtttttattaaataactaaactactccaaaccttttttcctagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaaggggtaggagccagctcttcaactttttttttgttttgttgttgttgtttttggagacagagtctcactctgtcgcccaggctggagtacagtggtgcattctcggctcactgcaacctctgcctcccaagttcaagtaattctcgtgtctcagcctcctgagtacctgggatcacaggcgtgtgccaccacacccagttaattttgtatttttagtacagacagggtttcaccatgttgaccaggccagtctcaaactcctggcctcaagcaatctgcctgcctcagtctcccaaaatgctaggattacaggtgtgagccaccgtgcccggcctagctcttcaactttgtcaggggttctaattcttagtattcattcactgccactgggatagttttctgaatctaggaatgtgttggccccataccctttagctatcatttagaggcactgactccactaaaggggggcttgttgggccatctttgtgtagaacctggggctagtatagagggctgcttgagtgcacaagttggctctcttcttgttttcaggttcttatcaatttgaataggtaatgttccataccatttcattgaagctgatcccaaaatgatcataacaattcttcatgtttttatagcactttacagtttataaaccattctcatatatattaccacttttaatcaccacaaaaaatccagtgaagggccaggcgcagtggctcacgcctgtaatccctgcactttgggaggccaaggcgggcagatcacctgaggtcgggagttcgagaccagcctgactaacaggaagaaacctcgtctctactaaaaatacaaaattagctgggcctgatggcgcatgcctgtagtcccagctactcaggaggctgagacaggagaatcgcttgaacctgggagggtggaggttgcagtgagccgagatcatgccgttgcactccagcctgggcaacaagagtgagattccatctcaaaaaaaaaaaaaaatccagtgagatatttactatttgcattttccagatggacccccgacccacaggagggaaatgaccttgcccaaggtcgtaaaactaagtgatagtcaggacttgaaaccaaatattctgactccaagtccagtttgtttcccccacatcatggttatgtcagtaaaaaccatagaccagaagttgagtgggtactttatctttgcctaacagagtaattttactctctaggctaaggaacaaaaagaattacagaaaaagctaataattaagatcaaacacactaagttaaggctacttaggaacaatccgacttaggcatgctttattttcttatacaatgatagtcctactcaaacctagatgttttatgttgaaacattaacttcccaggcattacagttcagcaccactacccccaactgtgccctgcagccacattccacttaaagagaacagttcacaagttatcttagctggcttcctacattatttgatttgattagcctatagctcatcacctggggaactaagccttataaacccacaccaccaggatgaagcaagtcataagatatagacagccatggtggtaagtcatttggtcagtcagaatcatcaagaatgcaacatatcatgtgctcatagtgaaactaagagctcatccttagcttcagagagtttataatctaatgggaaaacaaggtaaaggaatagaagcctaccatagaacctcagcatattcgtctcagggagatggaccggggagtttttggtttgtttgttgtgttttttcttttgagacagagtttcactcttgttgcccaggctggagtgcaatggcacgatcttggctcaccacaacctcctcctcccgggttcaagcgattctccagcctcagcctcctgagtggctgggattacaggtgcccgccaccatgcccagctaattttgtatttttagtagagatggggtttctccatgttggtcaggctggtctcgaactcctgacctcaggtgatctgcccacctcgacctcccaaagtgctgggattacaagcatgagccaccgtgcaagtttttaagagtgactataaagccaaaccaaggaggtgtaatttaagaaaatgccatgaaagaggtgactattgctgcgttgtaagacagaaagggaaatacagtcttgggagcaactgggagacatttctggcacaatgaatagcatattcctaagacttgaagatggtagtggaacagagagttgggacacttagagaaaatggggcagagcgtgtctctttctttcatttactcaacaaacatttatggacgttttactatagttgaagtagagagcatgagctgaatgtagattaaaaggtcagctaagtaataggaggcagagttgagaagtacacacagaaaaatggtagaggccaggcgtggctcatgcctgtaatcccagcacttcgggaggccaaggcaggcggatcacctgaggtcaggagtttgagaccagcctggccaacatggcgaaaccccatctctactaaaaatacaaaaatcagccaggcatggtgacgcatgcctgtaatcgcagctacttgggaggctgaggcaggagaatcgcttgaacccaggaggtggagatggcagtaagctgagatcacaccactgtactctagcctgggatacagagcaagactgtctcaaaaaaaaaaaaaaaaagaaaagaaaaaaaatggtagagggcctaaagccctggaaaggaatttccaaatatgaggtgaatacaggtatacttgtcctcaaggaaagcttcatatatttattagagcactgttgctctaagcttaaaagggcaacatagaagtatagcaaatattgcagtaaataatatttactattagtgataaatcctacgtctaaaacaatgaggaattactgttttctaggcttttcccctgattttataatttggaaagtgaatataactgggctttaaagggaacaagttagcataaaatctggtttctctaaagttaccttttggcagtctgaaagtacatggatactatgactgctctttgatcagactgcttgcagacatattacctgtagaacttgatgcttcacagaggacctttattattactgcttcaacccagctgaagctggctgggactatcactagattactgaaaaggagactgaagcaggcaccaaaatgatgacttgtccagagttaatggcttcctcactcagccacatttcctatatgtactaaggagatgctggggggtaagtcatgtgctatcatagaaaaagtagtaacctagaagccagatagacatgggtcttgagtttgccacgggttcattgagtaaccttgagcaagtcagtctccctgggcctcagattccttacctatgcaatgcagggtctagaacagcggtccccaatctttttggtaccagggaccggtttcgtggaagacagtttttccacggactggttgtgggggtggtttggggatgaaactgttccatctcagatatcaggcattagttagagtctcataaggagtgcgcaacatgtgcagttcacaacaggattcttactcctatgagattctaatgctgccactgatctgacaggaggcagaacccaggctgtaatgcttgctcgcctgcagctcacctcctgctgtgtggctcagttcctaacaggccactgaccagtactggtccccagcctaggggttgtggaccccctggtctagaacagattatgtataaggttccttctaggactaatatcctgagtcaaagtaacagtcaaagttgtgtaaatgggttttaataacaatgcttttatatggtgttatatggtatctgaaaagttaggaggaatatatgcaaaagcaccttgtgaaggatacagtatcatgcagatattgttgttaaagcactgtaagcattttacaaatattctcatttgtcacatttggcagaaaagaggaagcaggtatttttgcctctaccttactgatgaaggaatagcctgggcacggtggctcatacctgtaatcccaatacttggggaagccaaggtgggaggatcacttgagcccagagttcaaggctgcagtgaactatgattgtgccactgcactccagcctcagtgaccgagcaagaccccatctctaaatttaaaaattaaaaaaaaaaaaagaatggagattaacttggatgaagtgacttgtccaaggtcatgccaagcattaaatataggactagagcctgagtctcctaattcctagtctggtattctttgttttttgtttttgccacagcatcacttaccaatcctggtattttttttttttggaccagatctcatccttctgaagtatgaggtacagtgtaacactgagcttggtgctagaggaattatggactctaaagcagtagttctcaagtctagccacacattggaacacccaagggagcttttaaacatggagcctaggactccacccccagatattctgatgtaattagtctgaggtaggacatggactttttgaaaagctccccagagatttcttatgtgcagccagagttgagaacaactggcttaggggaaacccagactctgctttccactctctacaaagaatcccttggccgggtgtggttgctcatgcctatcatcccagcactttgagaggccgaggtgggaggattgcttgacgccaggagttcaagaccagccttggcaacatagcaagatcccatctctacaaaagaaaaagaaaaaaaaaaagagtccccctattacttctcaactacggtgctgggacatgctggtgggttgccagcagttgtgatacacacacacacacacacacacaccaccctgtatacatgtattaaatacatttgtagttatgcctgtgatagggacacattctgtctttgacattctaatctgcttcttggtgtgagagagaataggatgaagttacagctcatgtacctggcattcacgcaactacatctgtcatgtatgtcatgactgtgctataataccactaccaggtatttatctaacctcttcttgcttgaagacttctagtagggggaagctcacagtcttataggacaacccattggattccactaattgttagaaagttacttcttgtttagctgaaatgtgctgtcctatacatcatcccagtaggtcttggctgtgtaagagcctaatcattctttatgacagcccttcagatactgctttcatgatattatccctaggataaaatagagaaacatggatgaggtaacagcatttttgaagcatttagatgaatttgtaaatggccaaaggaccatacccaggctgtagcaatcaatggatcactgtcatcctggtgaagtatcaccaggacatgtcatagaactccatctttcatcctgtcttaaagcagcaaagattttttgttatgataatgtctagcgttggcaagggtgactaagaagggcacttctggccgggcgccatggctcacacctgtaatcccgacactttgggaggctgaagtgggcagattacttgagcctagtagtttgagaccagcctgggcaacgtggtgaaaccctgtctctactagaaatacaaaagattagcctggcatggtgacacacacctgtagtcccagctactcagtgggggctgaggccacaggatcacttgagccctggaggttgaggctgcagtgagctctgatcatgccactgcactccagcctgggtgacagagtgagaccctgtcttaaaaaaaaaaaaagaagggcatttctgtattgctattaggaatataaattggtatacctttcaggaaggcaacttgaaaatacgtatcagtagcctttaaaatgtttctatcctttgacccagtaattttacacatacaaatttatactgaggaagtagacattggtatgtaaatgtatttattcgtttgacaaatttttttctgagcacctatgtgccaggcactgtttctagatgctgagaagacatgaaacaaggcaggtgagattctttaccctcatgaaactggtattcttgtggggagagacacatggtaaccagaaaaataaaataattttagatagtgatgagtgaaaaagaaaagaaaatatagtgaagtcatagagaatgtgggatgggaaaagagcactttagaagagtgcttggggccaggcgcagtggctcacgcctataatcccagcactttgggaggccgaggtgggcggatcacttgatgtcaggagttcaaaaccagcctggccaacacagcaaaaccccatctctactaaaaatataaaaattagccgggcgtgatggcgcacgcctgtaatcccaaccactcaggaggctgaggcacaagaattgcttaaacctggcagaggttgcagtgagctgagatctcgccactgcactccagcctgggagacagagcaagactccatctcaaaaaaaaaaaaaaaagagtgcttgggtaggccgggcacggtggctcatgcctgtaatcccaacactttgggaggctgaggtgggaggactgcttgaggtcaggagttaaagaccaggctgggcaacgtagcgagaccccatctcactaaaaacaaattttttttaaagaagagtgcttgtggagctctctctgagaaggaaatatctaagctgaggcctaaacagtgaagagcaagtcaggaaaagcatcagaagaacatttcaggaaaagggaacagaaaatgtaagacctcagggcaggaatgagcttagtatctcaaggaacagctaaaaaggccagtgtgactagaatgtatcaagcataagctacagtcaggggatgggtagtcaagggccagatcatggagggccttgtcagtcgtggtacagtttagattatatttctatacaaggatatctactgcaacatgatttataatagtgaacaatttctttcaaaacaatcttaatatttaacattaggggactggttaaataaatcgacattatccccatgaggaaatatatacaactattaaagtcaagttttttgattttcaaattttgtaaagtgatatatattattctgctaatcagaaaaaaaatgttattgtggtttctacagagcaactacagagcaaaggtgatggttctcatatgaaaaaaacttaaaggcttgaatttgactataagctcagtatgaatccacaaagatgtgacaggaaaaaaaaagcaactgattttaggcctcatgaacaggactactgggtccataacaagggaggtgtttatcacagtccacctcacagtggccacaccacatttagaaagttgtgctcatttctagatctcacaattgaagaactttgacaaattggtgtatagtcaaggtggtgaggatacatgagaaccatgtcatgtggcaaatcattgagggaactaggtacatttaactttgagaggatttggacagaaggggactggggagtaaaaattacgttcagggtttgaacagttattctataaaagtggggttaaactgattccatgtcattttagatggcagaattgggtcctatgattagaagttatatagaaactattatcacctcaggataaatagagcttcagataattagaccagggatgttaagaggggcttcatacatcaaaccagtctttaggtggtcgctgaggtctcttctcactctgttccttcatcctgtgagctcagccacctctgtcttttcaaagccaaactatcccactttcttctacgatttttcttatagcattgcttcctataattctgatcactcacctcttttttgtttaacatcctctttataaaacatacacactgacttcctgaatgtgtatacaagaaaacatgcttattgattaaactggtttaataaatggaaagcccttatagcagtgcctggcacacattaatgttagctatcactactgcagccttgtttataagaatggaaaatggcactatcaggagaatgggtaaattgtggcaacttcatagagtgaaaatgaatggaattgaagctatatgtatcaacatatgtcatttatacaaagtttagaaacgtgtaagacaatttcttgtttgtttttgtttttttacaaaaactcttatgtgtggctaggtgctgttgctcacgcctgtaatctcagcactttgggaggctgaggcaagaggattgcttgaggccaggagttcaagaccagcctgggcaacatggcgagaccctgtctctacaaaaccaaaaaattagccaggcatggtggcatgtgcttgtggtctcagatacgctggaggctgaggcaggaggatcactaagtcaaagaggttgaggctgcagtgagctatgattgtgccactgcactccagcctgggtgacagagcaagaccctgtctccaaaaaaaaaaaaaaaactaatgtggtaagagacatacataggaatgataaacacctaattcaggagactgtttatccctggaaagggggaggcaaataggatcaggaaggagtgcataggagaccttggttatatctgcattttactattaaggggggttagtgggggcatgagtgaggttttttattgctattgtctatgcttttgtacacatgaacaaaattatggtgccctaaaataggatgcattatttctttttttttttttttttttttttgagacggagtttcactcttgtcgcccaggctggagtgcaatggcatgatcttggctcactgcaacctccgcctcccgggttcaagcgattctcctgcctcagcctcctgagtagctgggattacaggcatgcgctatgatgcctggctaattttgtatttttagtggagacggggtttcaccatgttggtcaggctggtcttgaacttctgacctcagatgatctgcccgcctcggcctcccaaagtgttgggattacaggcgtgagccactgcgcccagccaggatgcattatttcaaatgggatccagttgagccagggtacaatgaaataattactccccatcttttctgaactccaaatttctacctgactgcatttgctttgggacagccatttcaagctgttgactcacagagcttgcttacacctcaaatccctaggcccttttctgcacagtctttttttttttttttttttttttttgagacgaggtctcactctgtcacccaggctggagtgcagtggcgcgatctcagctcactgcagcttccacctcccaggctcaagtgatcctcccacctcagcctcctgaggttgacaccacgtccagctaattttttgtatttttggtggagacagggtttcagcatgttgcccaggctagtctcaaactcctgagctcaagcgatccacccgccttgacctcccaaagtgctgggattactggcatgagccaccgcacggtctacttttaagctagatcactccccatgttgtatttatatggctgagttgaggggaacctaaataccaaacttacaaacttactttctacttttaccccttaagtccagcctgtcaaaatatttttgaattgtgattcttttatcttacatattactaatccttccagctttctgtcattgttagagctgataaatatgcctaccttgtagacaagttatgagattcaaatgagattttgtatttatgtacatgaaagtactctgaaaactgtaaagtgctatcaaatgtaaatgattttatttcatatcatcagtgatttatcaaaatgtgttaaggacaaagcccaggctaacactggacaaaatgcagaaatgtgagctggatgaaagtacagcttggtaattctaaaaatactgagcaactacacttagtttttaaatgtacttaactatactaccatccagctcacagtgcttcactttacccataaagttgtcataagagtctttgtcggttgccttgcattattatgctatccctctgatctgtccttcaagtattctgtccaaaagaaaatggatttttcagccaggcgcggtggctcacgcctgtaatcccagcactttgggaggccaaggtgggctgatcacctgaggtcaggagttcgagaccagcctgggcaacatggtgaaacccccgtctctactaaaaatacaaaaattagccaggtggccaggcacggtggctcacacctgtaatcccagcactttgataggccgaggcaggtggatcgcctgaggtcgggagttcaagaccagcctggccagcatggtgaaaccctgtctctactgaaaatacaaaaagtagccgggcatggtggcaggcacctgtaatcccagctactcaggaggctgaggcaggagaatcacttgaacctgggaggcggaggttgcagtgagcggagatcgtgccactgcactccagcctgggtgacataataagactccatctcaaagaaaaaaagaaaagaaaaggaaatggatttgtctggcaagacttgttctctttaaacctatgacggttcttggtgattattgttttcaccaaagaagagaggactaaggagattgaagcttggtagataatagtactttccatttttttctagaaaagcttgcaaatgaagggaagtcattttaaactagtcttctaaccctttcagtaatgtgtctttctgcaaacctgttttgcagtgttcctgcaagggctggtgtggaaacaagcagtgtgggtgcaggaagcaaaagtcagactgtggtgtggactgttgctgtgaccccacaaagtgtcggaaccgccagcaaggcaaggtaggatcagggctgtttcctctccccttcccttcagaccttcctctagtttccaccctctttttctgccttccatcctgaaacctggagtctcctgcacagctcttccaacccttctccttccctctgcacccagaaaaagagacagttcacttctcaatcctttttccttgctgcttgcctgttcacatacccctttcagaaaccacagcacttcccaggagattcccaggtatagagctccccacccccaggcttggctgtaaagtttctgtactgtttttgagatgacaaagacaagaaagcaggcattcacaggcatatagacatgcaggatcaaattagtccagaggtttaactggaactgtaagagccacgtactgaggtagcagcttccaggaagttaatccttttgacatctcgagacattcgttacctagactctctccatggcaaccagctagctattccatggctctagaaaaagacccacaggaaccaggcctttctaatagtcactgttgtaaaccaagttaacctaaatgtcctcttaatattgctcccaggaatagcaaactcaggaaaaccaaatgttccctgggaagagcagcaccaagcaggtcagatccctatacctgccttacacctacctgtgcaatagcaaaaatgcattactacagctctatatgtgatatacagtaattctagcaagcacaatctaatgatgattcatcatgcatttcttgaacatccacatgtgaagagtttcaacctgcatcttctattaaaaagacctctggccgggcacggtggctcacgcctgtaatcctagcactttgggaggccgaggcgggcggatcacgaggtcaggagatcaagaccatcccggctaacacggtgaaaccccgtctctactaaaaatacaaaaaaattagccaggcgtggtagtgggtgcctatagtcccagctactcaggaggctgaggcaggagaatggcgtgaacccgggaggcggagcttgcagtgagctgagatcgtgccactgcactccagcctcagcgacagagcgagactccatctcaaaaaaaaaaaaaaaagacttctaacatagataggcaagctagaagtcaggctaagaactgtagaagtagcagagaccttaaggatcctctattcctgtggtttttcagtttgcgttcaagagtcatgtagtagctccatgaaagggcctccaggcagaggggcatggccccttcctccctcctcccatctctatctgtctctctctcggactcagttttcttaactgaaaggaacacccagtatggatgctaaaagagatattgcaaattgtagagagggggagtttagtcaaacaaatgaccgaggcttgtctttgctttaaacctggccttgtgagatgtcccatgcaactacctagtctttgccttcagaggccacctacaggcattgctccattccttcagggacagagcgtgtcaaacactatgacctccccaagcagggcctccctaagacttgcttcagctgactaatcaggcacttagagctgttacctctttggttgaatgggagcagactgattttgtaaacctggcagccaaatttataatatgcctgtctgcttgattttcaggatagcttgggcactgttgaacggacccaggattccgaaggctccttcaaactggaggatcctaccgaggtgaccccaggattgagcttctttaatcccgtctgtgccacccccaatagcaaggtaggtgggctaaaaggcaggcattggaaaactggattagcgtccttctctgcattatctatgagagaccagtaggagagaggcaggtggagtaaaggtgtaatcagcttgctgggaactagggatcgggcatagactctagtctggttttttccatagaatgatcttaaagaacacttcatactactgggagtatgtcgagcatctatagcagctcggctgggctgagcttctgcccctttctaaagtctattcatacctgtctctgtccctcctagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctactgttt

SEQ ID NO: 5713 - DNA, 60626 bp, human; identical to SEQ ID NO: 3458

SEQ ID NO: 5714 - DNA, 60626 bp, human; identical to SEQ ID NO: 3458

SEQ ID NO: 5715 - DNA, 60518 bp, human; identical to SEQ ID NO: 3464

SEQ ID NO: 5716 - DNA, 60518 bp, human; identical to SEQ ID NO: 3464

SEQ ID NO: 5717 - DNA, 58810 bp, human; identical to SEQ ID NO: 3463

SEQ ID NO: 5718 - DNA, 58810 bp, human; identical to SEQ ID NO: 3463

SEQ ID NO: 5719 - DNA, 53182 bp, human; identical to SEQ ID NO: 3457

SEQ ID NO: 5720 - DNA, 50389 bp, human; identical to SEQ ID NO: 3459

SEQ ID NO: 5721 - DNA, 43455 bp, human; identical to SEQ ID NO: 3462

SEQ ID NO: 5722 - DNA, 37130 bp, human; identical to SEQ ID NO: 3461

SEQ ID NO: 5723 - DNA, 232486 bp, human; identical to SEQ ID NO: 3487

SEQ ID NO: 5724 - DNA, 232486 bp, human; identical to SEQ ID NO: 3487

SEQ ID NO: 5725 - DNA, 4800 bp, human; identical to SEQ ID NO: 3491

SEQ ID NO: 5726 - DNA, 4791 bp, human; identical to SEQ ID NO: 3490

SEQ ID NO: 5727 - DNA, 2556 bp, human; identical to SEQ ID NO: 3492

SEQ ID NO: 5728 - DNA, 121161 bp, human; identical to SEQ ID NO: 3494

SEQ ID NO: 5729 - DNA, 5258 bp, human
ggctgagctgggcggagcagctgaaaatccggcgcgcgcagtctccagccccaatttctacgcgcaccggaagacggaggtcctctttccttgcctaacgcagccatggtaagccgtttagttagcgagctcttaggacgtatccgcctccatcctcccccggccggggctgcccgaggtttcgggattcctactggggatggccgggcagaggcgaagggatcacggcctccgtggtaggccgggacgggctccagggcgaagggcgaacgctggcctagggttggggaggcgcagatctggtgctgctgttgggaaggcctcggtttctgacccggccatacgtcctgatcccgggagaagctgcttttcctcccgggccggagccgcggctgggccaggagctcagactgcgagcccgaggttggtgggcgctgggggtgcccggcggagaaaggttttctttgtcattgcctttttggcacggcctgactttaccatacgtggccggtaagcatctggacacagcattaaaaaggcttccttactctttttaaagtaaaattggtgtcagcttttggctttagtgtacgaaggagcagcacatgtgtttgtgcggatgtcagaatcttgttccatacgtgtcaaaaacagacggtaataaattgtgaaaactttagaaacacaggtagactcctggctcatttctgttgctgtgcgtttcactagtatggtgttcttgaaagaccctaacctctaagcagatacagtttcaaacagtaacatggaaacactttagcaaggttctgaaagatagtaatcagtaaacgttctgaaacatagtaaccaagaatattctctgttacaataagaaggcttgttgcagcttatggatctcacggtgtttgttaaataactgtgtttgtttctgttttatcggaacactatactttaatattgtccacattttgctgaagatgaaactaaactaagagtttagtttcacactaggttttataagctgttctgaaacctgattaacagcattgcaatctaaaactttcaggctcgtggtcccaagaagcatctgaagcgggtggcagctccaaagcattggatgctggataaattgaccggtgtgtttgtaagtatcttatataaatatttccgtggccactgtttttaagtgtctcccaggactcatttggggaccaggctaggggaggaatatctattcttggcttcctctgcccttgaaggagctatactatctagctgtcctccacttccaatcgatttaatatttttgtgcctcatttattccacataccacatagtacatttacatggactcaggattcatgttcttaatgatcctggtcctctgacagggaagatgctataaaactttaaggtatgaaatagttttggatgctttttacacctcctgtgtaaaagtccaagttgggtgtaatatggacggtcttggtgttcagttagtggatctggtggactaggaggtaggtttgagtgctttagtgaatcccaacagtgattatcatttttaacgttacaggctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatgggtaagaagttttaaatactctggagacgcatattgatggcagccctatggtatccaaatactgtcttgatcatttttctaacctttgtaatctgtcaagtctcagaaacaaagcctgaccttccctctgttttttacttaaataaaaaacatgcaaataatcatgaaacgcttttcaaaactaaatttcgattcacttttaaattttacatgcagtcatggggttttgaaatattgaagatctggccgtgatctttaatcttcagaatccttgttggattagaactgggaggcacatgggggttctttttgtttcgtagagagctatggttgttgctcggcatgaggtagtggggatcactgtatgtagtaaccggttactgcttgatttcagatgtcatcagcattgacaagacgggagagaatttccgtctgatctatgacaccaagggtcgctttgctgtacatcgtattacacctgaggaggccaaggtgagtgtggcaagcaagctgggtctttactcagtatagttactttgttctaagggcctgcattgagtacgagtgctgcttgcaatgaggtgggtattgattagttaaaatctcatacctggaaatatctagctaacaattcgatgagattctgtcttacatgtaactttttgtcatgttattaaaagtctggctgatagctgtagggcattgatggatacctaaaattggcccccatttgaagttaacttcctcagcagattttctttttttgtggtagaaatgaattccagttgaaccgcgacttcctggtgtctcttaagagtcaaggagaatgatttctgggaacttgtttattgggtacctgacgtaggagccctttgccatgtctccatttgtgggagtagctttactttggggaggggaaggtgtcgatggaggaaacagacagtccttgaggcactagtttgaggtttaaaaaaagattacagtctttgattatttaatccagtttgttttgatggttttacacaaaagtttagggctgtttggattattggctgtaaatgaaggttaatttaattgactgatgtggctcctaatttccttttgcacagccttgttaacagcagactggagggcacgtccagtgggatctgtgattatttgatttacttcaaggatatcagggagtagagatccaaaattgaaatgctatgtgaagtatttgttgattggatgaactggtaatgtaattgctgtttgtgagacaaaactcagtcgtgatgtacagggagccattaagataaagttgagttgaagggaagaattcccagggccccataaggcttaaagagcctgggaaactggagtggcatttacattggaggagtggagggcaatggtggatgttaggaggacgagcctagagaagggctttatgcaacatacacttgagggtggaaagaacgatcagcgtcacaattaatctgcagcagttagggaacccatggttcctgtatagggttaaaaagtacatgtgagatggattgaatgtggctaacccttgtatttttctagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaagcatcctctgtgctacctgggcaccctctttaaggcctagatcattatgaattgcacagggtctgggtatctttattaaaaaccatctgctccaatcgcccaggtgtgtttatagccagaggcacaaatgctcagaatactcatttcttttctttaaattgtttgttttttatagaggagggtcttactgtgttgcccagactgttctcgaactgattataggtgtgagccaccaagcctggccacaaaatttcttacgagagtcccgggagtcctagcataggcagcagttccatatgaggaaattcaaatggggggaaaggaggaataaaatttgtttggacccatctctgagctgcttgtcatttgttatattgagttgaagcagattatttcttcctgcctaggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaaggtaagtctgggttttccttctctctagtctgaggaaatatgtaaatgcaggtggctgctgggattgtagcatccaggctcctggctggctctgctgaacctagtgcaaagcctcttctggataggactcacgcagagctgggctgagtcataatgattagccttaggtactactaaactttgactcacttgaataaatggtaggtgcctgctatgcacaataaacttctaagacattaattctgaagggcatacggtgagtttcataggacagccccagaaacccaagcagtgggtgcttttggtaaccagcatctgtgtcttgcaactgcctagctgatgccaagcactctcacaaacaggcttcagttctgttaagtgaggtgacaaatgtagcatgtgccaagccactatgagttggtgtgtggtgggttttgattctgcttgttttctcttccagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagcattttggttttgtgggttgtttttttttttaattcagtttcctgctattttactgtataacatgaacagtgattaagttctcaggcaggcttaggcagtctgttattggctgggcttagttagtggtgggaagtagaagataccagacttgggaaaggaacagcaactaaccaaggagtagaaagagccaagaaatcccggagtatttatctcccccgccttgacttggccaagaacttctctacacagtggacccctctgccctgttaagttcccttggctttctaaaaatctgccctcattttcttctccagtctgtattgcactagcccatccacaagcctggctcatctgtttttcccactcctgtgcccatcttgccaaacgcaggatgaaaatctccagttgccattaaaggtggtcataaatgggctgttgatgttgcaaagcattgcagttccttggacttagtgcccttattctccagctgccgctgcagtcctcaactctgtttttcagaggacagagatgtagaacataaacttgttcttgcttgtccaa

SEQ ID NO: 5730 - DNA, 3514 bp, human
gtcccaagaagcatctgaagcgggtggcagctccaaagcattggatgctggataaattgaccggtgtgtttgtaagtatcttatataaatatttccgtggccactgtttttaagtgtctcccaggactcatttggggaccaggctaggggaggaatatctattcttggcttcctctgcccttgaaggagctatactatctagctgtcctccacttccaatcgatttaatatttttgtgcctcatttattccacataccacatagtacatttacatggactcaggattcatgttcttaatgatcctggtcctctgacagggaagatgctataaaactttaaggtatgaaatagttttggatgctttttacacctcctgtgtaaaagtccaagttgggtgtaatatggacggtcttggtgttcagttagtggatctggtggactaggaggtaggtttgagtgctttagtgaatcccaacagtgattatcatttttaacgttacaggctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatgggtaagaagttttaaatactctggagacgcatattgatggcagccctatggtatccaaatactgtcttgatcatttttctaacctttgtaatctgtcaagtctcagaaacaaagcctgaccttccctctgttttttacttaaataaaaaacatgcaaataatcatgaaacgcttttcaaaactaaatttcgattcacttttaaattttacatgcagtcatggggttttgaaatattgaagatctggccgtgatctttaatcttcagaatccttgttggattagaactgggaggcacatgggggttctttttgtttcgtagagagctatggttgttgctcggcatgaggtagtggggatcactgtatgtagtaaccggttactgcttgatttcagatgtcatcagcattgacaagacgggagagaatttccgtctgatctatgacaccaagggtcgctttgctgtacatcgtattacacctgaggaggccaaggtgagtgtggcaagcaagctgggtctttactcagtatagttactttgttctaagggcctgcattgagtacgagtgctgcttgcaatgaggtgggtattgattagttaaaatctcatacctggaaatatctagctaacaattcgatgagattctgtcttacatgtaactttttgtcatgttattaaaagtctggctgatagctgtagggcattgatggatacctaaaattggcccccatttgaagttaacttcctcagcagattttctttttttgtggtagaaatgaattccagttgaaccgcgacttcctggtgtctcttaagagtcaaggagaatgatttctgggaacttgtttattgggtacctgacgtaggagccctttgccatgtctccatttgtgggagtagctttactttggggaggggaaggtgtcgatggaggaaacagacagtccttgaggcactagtttgaggtttaaaaaaagattacagtctttgattatttaatccagtttgttttgatggttttacacaaaagtttagggctgtttggattattggctgtaaatgaaggttaatttaattgactgatgtggctcctaatttccttttgcacagccttgttaacagcagactggagggcacgtccagtgggatctgtgattatttgatttacttcaaggatatcagggagtagagatccaaaattgaaatgctatgtgaagtatttgttgattggatgaactggtaatgtaattgctgtttgtgagacaaaactcagtcgtgatgtacagggagccattaagataaagttgagttgaagggaagaattcccagggccccataaggcttaaagagcctgggaaactggagtggcatttacattggaggagtggagggcaatggtggatgttaggaggacgagcctagagaagggctttatgcaacatacacttgagggtggaaagaacgatcagcgtcacaattaatctgcagcagttagggaacccatggttcctgtatagggttaaaaagtacatgtgagatggattgaatgtggctaacccttgtatttttctagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaagcatcctctgtgctacctgggcaccctctttaaggcctagatcattatgaattgcacagggtctgggtatctttattaaaaaccatctgctccaatcgcccaggtgtgtttatagccagaggcacaaatgctcagaatactcatttcttttctttaaattgtttgttttttatagaggagggtcttactgtgttgcccagactgttctcgaactgattataggtgtgagccaccaagcctggccacaaaatttcttacgagagtcccgggagtcctagcataggcagcagttccatatgaggaaattcaaatggggggaaaggaggaataaaatttgtttggacccatctctgagctgcttgtcatttgttatattgagttgaagcagattatttcttcctgcctaggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaaggtaagtctgggttttccttctctctagtctgaggaaatatgtaaatgcaggtggctgctgggattgtagcatccaggctcctggctggctctgctgaacctagtgcaaagcctcttctggataggactcacgcagagctgggctgagtcataatgattagccttaggtactactaaactttgactcacttgaataaatggtaggtgcctgctatgcacaataaacttctaagacattaattctgaagggcatacggtgagtttcataggacagccccagaaacccaagcagtgggtgcttttggtaaccagcatctgtgtcttgcaactgcctagctgatgccaagcactctcacaaacaggcttcagttctgttaagtgaggtgacaaatgtagcatgtgccaagccactatgagttggtgtgtggtgggttttgattctgcttgttttctcttccagggcaacaaaccatggatttctcttccccgaggaaagggtatccgcctcaccattgctga

SEQ ID NO: 5731 - DNA, 2993 bp, human
aatttctacgcgcaccggaagacggaggtcctctttccttgcctaacgcagccatggtaagccgtttagttagcgagctcttaggacgtatccgcctccatcctcccccggccggggctgcccgaggtttcgggattcctactggggatggccgggcagaggcgaagggatcacggcctccgtggtaggccgggacgggctccagggcgaagggcgaacgctggcctagggttggggaggcgcagatctggtgctgctgttgggaaggcctcggtttctgacccggccatacgtcctgatcccgggagaagctgcttttcctcccgggccggagccgcggctgggccaggagctcagactgcgagcccgaggttggtgggcgctgggggtgcccggcggagaaaggttttctttgtcattgcctttttggcacggcctgactttaccatacgtggccggtaagcatctggacacagcattaaaaaggcttccttactctttttaaagtaaaattggtgtcagcttttggctttagtgtacgaaggagcagcacatgtgtttgtgcggatgtcagaatcttgttccatacgtgtcaaaaacagacggtaataaattgtgaaaactttagaaacacaggtagactcctggctcatttctgttgctgtgcgtttcactagtatggtgttcttgaaagaccctaacctctaagcagatacagtttcaaacagtaacatggaaacactttagcaaggttctgaaagatagtaatcagtaaacgttctgaaacatagtaaccaagaatattctctgttacaataagaaggcttgttgcagcttatggatctcacggtgtttgttaaataactgtgtttgtttctgttttatcggaacactatactttaatattgtccacattttgctgaagatgaaactaaactaagagtttagtttcacactaggttttataagctgttctgaaacctgattaacagcattgcaatctaaaactttcaggctcgtggtcccaagaagcatctgaagcgggtggcagctccaaagcattggatgctggataaattgaccggtgtgtttgtaagtatcttatataaatatttccgtggccactgtttttaagtgtctcccaggactcatttggggaccaggctaggggaggaatatctattcttggcttcctctgcccttgaaggagctatactatctagctgtcctccacttccaatcgatttaatatttttgtgcctcatttattccacataccacatagtacatttacatggactcaggattcatgttcttaatgatcctggtcctctgacagggaagatgctataaaactttaaggtatgaaatagttttggatgctttttacacctcctgtgtaaaagtccaagttgggtgtaatatggacggtcttggtgttcagttagtggatctggtggactaggaggtaggtttgagtgctttagtgaatcccaacagtgattatcatttttaacgttacaggctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatgggtaagaagttttaaatactctggagacgcatattgatggcagccctatggtatccaaatactgtcttgatcatttttctaacctttgtaatctgtcaagtctcagaaacaaagcctgaccttccctctgttttttacttaaataaaaaacatgcaaataatcatgaaacgcttttcaaaactaaatttcgattcacttttaaattttacatgcagtcatggggttttgaaatattgaagatctggccgtgatctttaatcttcagaatccttgttggattagaactgggaggcacatgggggttctttttgtttcgtagagagctatggttgttgctcggcatgaggtagtggggatcactgtatgtagtaaccggttactgcttgatttcagatgtcatcagcattgacaagacgggagagaatttccgtctgatctatgacaccaagggtcgctttgctgtacatcgtattacacctgaggaggccaaggtgagtgtggcaagcaagctgggtctttactcagtatagttactttgttctaagggcctgcattgagtacgagtgctgcttgcaatgaggtgggtattgattagttaaaatctcatacctggaaatatctagctaacaattcgatgagattctgtcttacatgtaactttttgtcatgttattaaaagtctggctgatagctgtagggcattgatggatacctaaaattggcccccatttgaagttaacttcctcagcagattttctttttttgtggtagaaatgaattccagttgaaccgcgacttcctggtgtctcttaagagtcaaggagaatgatttctgggaacttgtttattgggtacctgacgtaggagccctttgccatgtctccatttgtgggagtagctttactttggggaggggaaggtgtcgatggaggaaacagacagtccttgaggcactagtttgaggtttaaaaaaagattacagtctttgattatttaatccagtttgttttgatggttttacacaaaagtttagggctgtttggattattggctgtaaatgaaggttaatttaattgactgatgtggctcctaatttccttttgcacagccttgttaacagcagactggagggcacgtccagtgggatctgtgattatttgatttacttcaaggatatcagggagtagagatccaaaattgaaatgctatgtgaagtatttgttgattggatgaactggtaatgtaattgctgtttgtgagacaaaactcagtcgtgatgtacagggag

SEQ ID NO: 5732 - DNA, 5512 bp, human; identical to SEQ ID NO: 3497

SEQ ID NO: 5733 - DNA, 4274 bp, human; identical to SEQ ID NO: 4723

SEQ ID NO: 5734 - DNA, 4274 bp, human; identical to SEQ ID NO: 4723

SEQ ID NO: 5735 - DNA, 5540 bp, human; identical to SEQ ID NO: 3499

SEQ ID NO: 5736 - DNA, 5337 bp, human; identical to SEQ ID NO: 3496

SEQ ID NO: 5737 - DNA, 4014 bp, human
agcaccggacttggagtcagagagacctggctgcgaatcccggctccgccactttctagcgctgtgaccttgggcaagttaccgcacctctccgagcctctctcactcttctcctagcggggttttagcactgaccgcaggcggcttggctagggggtaggctcagcctgctgccgcgtcggatgctcagcgggcgctcagtaagtgttgatcaggcgcgagagtggcagcagccggcgccggagtgcggactcgccgcggaggccgacaccccgtgccccttcctgcctgtccatcctgtctctaagatcagttcctgatacagcacttgcgggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccggttggtgccattttaacttttggtcccccaacaggttaaagatgaggcccccacctgcctctcccttctcttttccctctccccttcccacccctgtctaggcgggagggggctgctcgcccaagggaaggcctgaagcgaagagcgggcagcgggactgggaactggtggccggggggccgccaggcatcagccggcgagaaggcacttgttgctctaggtttcccagccgcctgtcgcagccgtttcgcagtggtcagctcgcggcttggagagcgggctgggacgtttccgcgttgccaagttttgcccacgaacgggctagagggtggtggaggagggcagaaagccggggaagcagagccagggatgccgatggaaatgcgattgcttcttcagacgcattcaacaacacttactgagcgcctattgagcgcagacccaggctggggtcagggtgggtggtgggtcagtaatggaaggcagaagatctgaatggacacagggcctcttctgggggagctcccagattgaagagggaggcgcggtaaaatggtcttcccccacgaactgatatcagaatagagagagtttttttgctcgttctctcttttgatttttctaatgtttctcttttggttttgctgttgttgctgctgctcctgttgttttttcttcgttttgtacattcgggtaccaagcggcaaaaaggagagggaaggctggataggaacaggaaaagatggacagggcccccagacatttttcttaggacaggaaaattgtctgatactgattgtgctagggctcttgaagacgacatgtgttagacttcttgtctggtgatcacttgcttttgaaatatttttctacggttgcctcagagaaggagcagggcttcaatcaagcaatgatgcgggacccaacagctgatattttttcctcatgtttttaaaaaaatgtttacccctttctctattttttccctcccctacccccatccacccaagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagaggtatttataaatatgaaattctacatctctaattgatcatgaaagctagaatatatggggctttttttttttaaagagatagggtcccgctatgttgcccagcctggtatcaaactccagggctcaggtgatcctcccacctcagcttcctgagtagctgagactacaggagggtgctactgtgcctagctatgggacatttttttcttctttgtaaacaggcctccaggaaaataagttgagattttcagaggtttgtttattttctggtttggaggtattcttttgccttcattcccttatcctttggcacttgagccaggaaatcacttctttggaagccttttgaatccagctaggtatgatgacttagccagtggtcaggtgaggcatgtggccataggggtgctagattctgctcccagaaccgctgctacctgactaaaaaggcattgaatctctgtgcctcacttgtcactatagatgggaatggctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctccagcctggatgctagtagcccattgagacaatatgttgcttactcagggacattcctgtcctctgaaccaggaacagtgccaccctcacccccacacatacaccttgggactgtgaagtcacttgcatgaggaagcagtatgtcccatcttggtgatatgggtaggtggctgcctgggcagtacctggccgaatcaagcacctttcctgcctcaggcaaaagttccagcttgatctcctccctgtgctcgggtgatctctggtcttgattctaactcagtcaccatccttgcctcatagctgcgtggcattgccctgctttgggctttgctagtgctttgttggtcagtgaagccttttgcccttaccactgcttcttcctcacttgcagcacaacagctccagctggcagcatcacttcccgccaatttatccaacttctgccaaggctctgaaatgccaacaacgtcgaggcctgcacttgatgtcaagggtggcacctcacctgcgaaggaggtaatttttgccattttacagatgaggcagggaaagacaaattttccggggtcatgggccaggccctcctaggtgcattacccagtgtccttgagcagagaggagacaacaggactatctctggggagaatgagaacagcttctgcctaaattgtggtcagattgaacccactaggggtgttgaaagatggcagggaagggagcagagaaattgagtaggagcaaaaccactctgttgaagagactaaagtgaggctgagaagagggacaggaggtgccctttttaggatggtgaggtggaggctatggggaaggagctgaaagcagtgaacccacttaggatggcaggtgctccagcactgtaactgggctctggcctcagtgctcagagccatggcagcaaaaggatgcttgaggtgggagcctaattttcaagggggtcgtcttgctacctctccacctctagtcccaaatgaagtgcaggtaggaaccttctaaatctgctgaatggtgaaggacaagccaggagcagggttactatggtgtgcttttctctgtcttctaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctg

SEQ ID NO: 5738 - DNA, 3597 bp, human
gggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccggttggtgccattttaacttttggtcccccaacaggttaaagatgaggcccccacctgcctctcccttctcttttccctctccccttcccacccctgtctaggcgggagggggctgctcgcccaagggaaggcctgaagcgaagagcgggcagcgggactgggaactggtggccggggggccgccaggcatcagccggcgagaaggcacttgttgctctaggtttcccagccgcctgtcgcagccgtttcgcagtggtcagctcgcggcttggagagcgggctgggacgtttccgcgttgccaagttttgcccacgaacgggctagagggtggtggaggagggcagaaagccggggaagcagagccagggatgccgatggaaatgcgattgcttcttcagacgcattcaacaacacttactgagcgcctattgagcgcagacccaggctggggtcagggtgggtggtgggtcagtaatggaaggcagaagatctgaatggacacagggcctcttctgggggagctcccagattgaagagggaggcgcggtaaaatggtcttcccccacgaactgatatcagaatagagagagtttttttgctcgttctctcttttgatttttctaatgtttctcttttggttttgctgttgttgctgctgctcctgttgttttttcttcgttttgtacattcgggtaccaagcggcaaaaaggagagggaaggctggataggaacaggaaaagatggacagggcccccagacatttttcttaggacaggaaaattgtctgatactgattgtgctagggctcttgaagacgacatgtgttagacttcttgtctggtgatcacttgcttttgaaatatttttctacggttgcctcagagaaggagcagggcttcaatcaagcaatgatgcgggacccaacagctgatattttttcctcatgtttttaaaaaaatgtttacccctttctctattttttccctcccctacccccatccacccaagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagaggtatttataaatatgaaattctacatctctaattgatcatgaaagctagaatatatggggctttttttttttaaagagatagggtcccgctatgttgcccagcctggtatcaaactccagggctcaggtgatcctcccacctcagcttcctgagtagctgagactacaggagggtgctactgtgcctagctatgggacatttttttcttctttgtaaacaggcctccaggaaaataagttgagattttcagaggtttgtttattttctggtttggaggtattcttttgccttcattcccttatcctttggcacttgagccaggaaatcacttctttggaagccttttgaatccagctaggtatgatgacttagccagtggtcaggtgaggcatgtggccataggggtgctagattctgctcccagaaccgctgctacctgactaaaaaggcattgaatctctgtgcctcacttgtcactatagatgggaatggctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctccagcctggatgctagtagcccattgagacaatatgttgcttactcagggacattcctgtcctctgaaccaggaacagtgccaccctcacccccacacatacaccttgggactgtgaagtcacttgcatgaggaagcagtatgtcccatcttggtgatatgggtaggtggctgcctgggcagtacctggccgaatcaagcacctttcctgcctcaggcaaaagttccagcttgatctcctccctgtgctcgggtgatctctggtcttgattctaactcagtcaccatccttgcctcatagctgcgtggcattgccctgctttgggctttgctagtgctttgttggtcagtgaagccttttgcccttaccactgcttcttcctcacttgcagcacaacagctccagctggcagcatcacttcccgccaatttatccaacttctgccaaggctctgaaatgccaacaacgtcgaggcctgcacttgatgtcaagggtggcacctcacctgcgaaggaggtaatttttgccattttacagatgaggcagggaaagacaaattttccggggtcatgggccaggccctcctaggtgcattacccagtgtccttgagcagagaggagacaacaggactatctctggggagaatgagaacagcttctgcctaaattgtggtcagattgaacccactaggggtgttgaaagatggcagggaagggagcagagaaattgagtaggagcaaaaccactctgttgaagagactaaagtgaggctgagaagagggacaggaggtgccctttttaggatggtgaggtggaggctatggggaaggagctgaaagcagtgaacccacttaggatggcaggtgctccagcactgtaactgggctctggcctcagtgctcagagccatggcagcaaaaggatgcttgaggtgggagcctaattttcaagggggtcgtcttgctacctctccacctctagtcccaaatgaagtgcaggtaggaaccttctaaatctgctgaatggtgaaggacaagccaggagcagggttactatggtgtgcttttctctgtcttctaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactcca

SEQ ID NO: 5739 - DNA, 3838 bp, human
cggacttggagtcagagagacctggctgcgaatcccggctccgccactttctagcgctgtgaccttgggcaagttaccgcacctctccgagcctctctcactcttctcctagcggggttttagcactgaccgcaggcggcttggctagggggtaggctcagcctgctgccgcgtcggatgctcagcgggcgctcagtaagtgttgatcaggcgcgagagtggcagcagccggcgccggagtgcggactcgccgcggaggccgacaccccgtgccccttcctgcctgtccatcctgtctctaagatcagttcctgatacagcacttgcgggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccggttggtgccattttaacttttggtcccccaacaggttaaagatgaggcccccacctgcctctcccttctcttttccctctccccttcccacccctgtctaggcgggagggggctgctcgcccaagggaaggcctgaagcgaagagcgggcagcgggactgggaactggtggccggggggccgccaggcatcagccggcgagaaggcacttgttgctctaggtttcccagccgcctgtcgcagccgtttcgcagtggtcagctcgcggcttggagagcgggctgggacgtttccgcgttgccaagttttgcccacgaacgggctagagggtggtggaggagggcagaaagccggggaagcagagccagggatgccgatggaaatgcgattgcttcttcagacgcattcaacaacacttactgagcgcctattgagcgcagacccaggctggggtcagggtgggtggtgggtcagtaatggaaggcagaagatctgaatggacacagggcctcttctgggggagctcccagattgaagagggaggcgcggtaaaatggtcttcccccacgaactgatatcagaatagagagagtttttttgctcgttctctcttttgatttttctaatgtttctcttttggttttgctgttgttgctgctgctcctgttgttttttcttcgttttgtacattcgggtaccaagcggcaaaaaggagagggaaggctggataggaacaggaaaagatggacagggcccccagacatttttcttaggacaggaaaattgtctgatactgattgtgctagggctcttgaagacgacatgtgttagacttcttgtctggtgatcacttgcttttgaaatatttttctacggttgcctcagagaaggagcagggcttcaatcaagcaatgatgcgggacccaacagctgatattttttcctcatgtttttaaaaaaatgtttacccctttctctattttttccctcccctacccccatccacccaagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagaggtatttataaatatgaaattctacatctctaattgatcatgaaagctagaatatatggggctttttttttttaaagagatagggtcccgctatgttgcccagcctggtatcaaactccagggctcaggtgatcctcccacctcagcttcctgagtagctgagactacaggagggtgctactgtgcctagctatgggacatttttttcttctttgtaaacaggcctccaggaaaataagttgagattttcagaggtttgtttattttctggtttggaggtattcttttgccttcattcccttatcctttggcacttgagccaggaaatcacttctttggaagccttttgaatccagctaggtatgatgacttagccagtggtcaggtgaggcatgtggccataggggtgctagattctgctcccagaaccgctgctacctgactaaaaaggcattgaatctctgtgcctcacttgtcactatagatgggaatggctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctccagcctggatgctagtagcccattgagacaatatgttgcttactcagggacattcctgtcctctgaaccaggaacagtgccaccctcacccccacacatacaccttgggactgtgaagtcacttgcatgaggaagcagtatgtcccatcttggtgatatgggtaggtggctgcctgggcagtacctggccgaatcaagcacctttcctgcctcaggcaaaagttccagcttgatctcctccctgtgctcgggtgatctctggtcttgattctaactcagtcaccatccttgcctcatagctgcgtggcattgccctgctttgggctttgctagtgctttgttggtcagtgaagccttttgcccttaccactgcttcttcctcacttgcagcacaacagctccagctggcagcatcacttcccgccaatttatccaacttctgccaaggctctgaaatgccaacaacgtcgaggcctgcacttgatgtcaagggtggcacctcacctgcgaaggaggtaatttttgccattttacagatgaggcagggaaagacaaattttccggggtcatgggccaggccctcctaggtgcattacccagtgtccttgagcagagaggagacaacaggactatctctggggagaatgagaacagcttctgcctaaattgtggtcagattgaacccactaggggtgttgaaagatggcagggaagggagcagagaaattgagtaggagcaaaaccactctgttgaagagactaaagtgaggctgagaagagggacaggaggtgccctttttaggatggtgaggtggaggctatggggaaggagctgaaagcagtgaacccacttaggatggcaggtgctccagcactgtaactgggctctggcctcagtgctcagagccatggcagcaaaaggatgcttgaggtgggagcctaattttcaagggggtcgtcttgctacctctccacctctagtcccaaatgaagtgcaggtaggaaccttctaaatctgctgaatggtgaaggacaagccaggagcagggttactatggtgtgcttttctctgtcttctaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttca

SEQ ID NO: 5740 - DNA, 4701 bp, human; identical to SEQ ID NO: 3498

SEQ ID NO: 5741 - DNA, 135224 bp, human; identical to SEQ ID NO: 4729

SEQ ID NO: 5742 - DNA, 135503 bp, human; identical to SEQ ID NO: 4731

SEQ ID NO: 5743 - DNA, 135364 bp, human; identical to SEQ ID NO: 4728

SEQ ID NO: 5744 - DNA, 135364 bp, human; identical to SEQ ID NO: 4728

SEQ ID NO: 5745 - DNA, 133629 bp, human; identical to SEQ ID NO: 4732

SEQ ID NO: 5746 - DNA, 113114 bp, human; identical to SEQ ID NO: 3501

SEQ ID NO: 5747 - DNA, 16608 bp, human
ttgtgcaaataaggtttctgtggtgagacaccagataaactcaacttcctctttcaacaacaaatgtgtcagttatcagcaggatccatgccgccagagtaaagctttctaccctttactccctgcaaagaaacaagagtgcttatcccagctaagctccagggtaagttaatgcctagcacctggggattggtggtttcatgtgggaagattggtgtgatcataaaaatcagaacagaggtggatgtggggccagtgtctgtattaaaattgtcactggtttctcatctcagacatcttacaacaggagcaaagataattactgttgagtttgaccagagtccaaagttaacgttaatgccatcagtcctcttcattatgccaggagcatggagtctgtgatgcagctcactctttgatgagggctctttagagagtgggaccagagaagatggcacaaagtggtaagaagagtatattcagtgagactcattgggacaacttgacatattcggccaataaaagtcaatttaattttttatggtgtataatttatctagctgcatcgtgaaggaagatttttgggtataaaatccttgctttggaaaatttagctttcagagatactgagacaaatagtagaaagcagggtaatagattctgggggctgaaagggcccatagagatccaaatccctcacaatacagtcaggaaaactgagagccagtgaagtgaagacacttaggttcactcagcttgttagtggtataggtggatctaggacctgtgtctttaaactcatgtttgccttttcctacagcagtttgcatctcccagagaatactgtaaatttatttgtgaccctgccattttttaggataggaaaggagaaagtatcccagatgacttcagagtctggtcagagtggttccttgatcctttgaaagctaattttgaccgaagttcagccttactggatagcaaagcccatgagtgaggcactcattttttcagttattattgctattactctgaatactagcacctctctccttctgagctaagatgactaaatcaaaaggagactttcagctaaggagtccctgaagggagactgtgccaaatcatttggaaccaggataaggctggatagaatgataccagatttggctgtgctttccaggggagtaggctcagttccaagaatcctgcaagtgagaatatttttatttcagttgttcaaatggatgtgtggagtcattatgatgtatattaattggagaatctatctcttagcaattgcagcacagtaaaattaaccacttatgaaagtaggtgatatgcagatatactgaggtggaaaatggtgtaaactacagtcagaatcagatcacacatttggggcaattgtttttgcaatggttcctgttgaacacagattctttggccaaatgcagtttattttggggctcaactgggaaagttgtagagttcaagttgtacagactactcaaatctgaagacatcaaatgaataaacacatttatgggttgttttggtttgaaataagtgagttggggttttaaaagacaggccagcctgctgggcttggtggctcacgctgtaattccagcattttgggaggccgagacaggtggatcacctgaggtcaggagttcgagaccagcctggtcaacatggcgaaaccccgtttctactaaaaaatacagaaattagctggttgcagtggcaggcgcctgtaatcccagctactgggcaagctgaggctggagaatcgctcgaaaccgagagatggaggttgcagtgagctgagactgtgccattgcactccagcctgggagacagaccaagactctggctcaaaaaaaaaataaaaaaaagataggctgcctatctatactatagctctctgtcatggctcaagcaaagagaacaaagctgtttatagtaaaatgagactttctaaaagcactaacaatcagggcaatggttccccggtggtctatgatttattttaaaagcttttggcaaaaaggtttatttattcttcagatcagtatattttgtggagaagttttctcctagtatcagttcatatacatcacaggtagagtgatcaaatagatagatcaatacataaggagtcagaagtctgtgttatagttcaagttctgccaatgactggtgtggccttcggtgagttatttcatttctgtgcatctcaataatctcatctattataatgggagagggcttggaatagatggttcctaatttccttcctagcaatccaatgatttgagttagactgttagatacctaagaatagttaaatgttatggagtggtgaataatggggccataatagggaaatctatctagagaggacattctggaaatgtagttcagatctccaagagaactgagtatcctttcccaattgccattatatttctttcaggtaatgttatcatgacagcttcaacttttagaccacaggcaaatgctttgtaagtaatttcccttttttaaaaatgagaaaatgcaagacaaaagataaaactttctgaaatctaatttccacagtgacaatgacactcagttggcatttctcaatcttttaaacccaaggttccctttgagaaacgtaaacatttcactacaaggttactgtgaacttgccttcctagggaccagaccctggacttgtagaaaaatctgctccatcacattgacattttccaagtactaagtgcccaacagttaagaggattttgtagatctgtactttcacagtttgtattgtagaaacaataatgacattttttattttgttttccaaatatatttgttataataaggaatatgttttatcaagtaacacttattttctaccctttaactttaaaaattactgctctagatattctagtcctctgctacaactacacttcttaggggattttctaaatccagaaatgtacaggatccaaccaaaggcccttggagatgactctgtgtacaaataaagaggaaatgaactcacatttatttaatacttattgggtatcagacatgaaaataggtacttttacacacattttctttttttcatttctatttcaatattttttgaactacaagtgtttttttctgttgcatgggtaaattatatagcagtaaattctgagatttttagtgcacccaccacctcagtagtgcacgttgtacctaatgtgtaatatttttatgcctagcctgtctcacccaccctcttctgagtctctagattccattatatcactctgtatacctttgcataatcatagcttatctgtcacttataagtgagaacatctattttttttatttttcactcctgtgttactttacttagaatagtggactccacctccatccaagttactgcaaaaatacattattgcgatcctttttatggctgaggagtattacatagtgtatatacaccacatttactttatccactcgttagtcaattggcacatagattcattccacatctttgcaattgtgattagtaggattgctgtatcaaatggtagatttacttgtagctctttaaggaatctccatactgttttctatagaagttgtactaatttacatttctaccagcagtgtagaagctttctcttttatccacatatctaccagcatctatttttttttcactttttaataatagccattcttgcagtaacgtgctattttattctggttttaatttgcatttctctgacgattagtgatgtggagcattttttcgtgtttgttggccatttgtatatcttcttttgaggaatctctatttatgtcctttgcccactctataatgggattatttctctttctattgctgacttgtttgagttccttgtagattctagtttctagtcctttgtcagatgcatagtctgcaaatattttctctcattctgtgggttgtctgtttactcggattattattttcagacacatttttctttaatgctcaaaacaaattatgtggcaggaaccattctaattttacaaaagaggaaactgaagcctggtgatatgaagtgaattgtttcaggccagagaaccgacaattgagacatgatatgataccaggtcttccaaagaacatgattatttccacccataaaatgctgccacagctgcaaaaatgatatctaattaggccgccttcctaaatgattgaaagtccaatacatattcctgcatgaaagttcaaattcaaactttaagttgttgttttgttaatggtctaattgctttaattcattttaaggataaaaataattttcacttcctctaacagaagaaaatgtctgtacttgcagaatgtgtccaaatttgtgtgtatctcatgtcaaccaggcttatttggagttgatgtagatttattcaggaaacagcagagtttccaattctagctgctactctttggttctggttgtaagcggctgaatgaagaacaccggggtcatggagatcagattggcttggataattcatgtgaaatttagtggttaaaaaataaaagaaaaaggtaagatgaggcaaagcaagttaagttcccagatgacatgtaaaagttatcctctagagagtgggaggggcccccatcagcaacttgttttctctgtttaattttttcttcccctcccaggatgacaagcccacagacaggcttcagcatcaaataaaatggagaagtaaatttgataaacatgtttacttagtggtgccagtgacttactgatgagtggtgaaaagacagggaagattgagagtgaagatttatggagttggtaccagctgcataaatggtggcagtgtcaatggtgatgatattagttaggagcagggttcagagggggaattctcatgaaatcataccaaatgagagctagaagggagttaaaggtcatctagttcaaatcatattattttaataatgaggaaatgaaactcacagaagggaaagagcgtatcagagcagcacaaagagtatataaaattactgaaatccaagtatcttagctacaaatccagtacacctttctatatattatactgcttttgagtcttctgtatcctacagcaagtcttgtcctattcagatcactcctgttgtaaagaaattgttccattacttctatctacagatttgttataatttgaattcataagcacaattccataaagaacgttggttttgatataatcctatcctgacacctggtgggcagcaatttgccatatatgcatagtgcatatgcataaaactgctagaactagaaccgaaaacaatagcttttttatctctgaggaacagtcttatccacagaaataccactttaaaatatgtttctgtccatataataagttattcagctaaaaataactttagctttctgggcttatgaaaagccttattaaagctgaaatcataactctgactgcagaaagtcacttactcctgctgagactccattttctaatctgtaaaggagtataatagtaattaactcagaattcttacaaagattagaggtaacgtgaatagcacttagctagttactgacaggatgtggaaatttcctcactgggacttaggaaactaatataaattctgatgccataataatataagctcagtttggctgtaactttgtgaaaaccacaacgttgagctagttggttgggaagagcagctgcttttgggtagatggtattagtatctagtaagattttgggctcagctccaatgaatcatatttaaagaccttccatacctttgtattctgagaaaacatttagttgtttccacaaaataaagttttcagtgatcaaattcctaattaagtttaagggattcctgttggatttcaaaacgaaagctggattgccttctttaaagctcttaggtgttcagatttcttagactaaaaccttattattcttgctttgaccacattttcttcagtagcagaaaggagaaagattatggctgttgtttaggagagtgtttcatgggagagactttacaagtaaaaatgcctaatgctctgctaatatgtgcctatgctctgtagtcttaccttctcacagtgcagcctataaattcagtaggtgttcgaagaagaggggagtgagagtagggttgcccgatgtaaggaaaaaatgggagttgagatgcgatattgagacagaagtaaaatattgacctctgagttgggctccaggtaaaaaaggaatatgatggagttttagtcataactttgtgcgtgccatttttattatcaggaacatctttagagccatactttgatttttgtttttttgcccatattttcttcaacttttattttaagtttaggggtacatgtgcaggatgtgcagggttgtgacataggtaaatgtgtgtcatggtcgtttgctgcaaagatcatcccatcacctagttattaagcccagcatccattagctattcttcctgatgctctctctcacccaacagctcccaacagactccaatgtttcttgtttctcaccatgtgtccatgtgttcccatcattcagctcccacttataagtgagaacatgtggtgtttggttttccattcctgcattagattgctaaggataatggcttccaactccatccatgtccctgcaaaggaaatgatctcattctttttatggctgtatagtatttagagacacactttgtaagtgaatcctgttatttcagagatggtggctgatttttctgcttttcttattaggttaaaactctatgctggtcattcccttcaggatttggcactcaccaacatacccttctttcaagtgaaaaggcatctcttttaatggtcctgacctttggaataggaagcatgtaccctggacagagcacttcaaactagaggtaccaagagtaattacttctgtaaggctggcattggaggcactgggaattctattctcacctctttctgggtaattcaaagccacagaagtactgactgaagtgaggttgtggggacatgtatgccaccttgaagtgcattaaagaatggatataaagtgaggaaaagaaaaaaactggtgtaaacaactatggagagaagggcaggaaggcaacaaagagctagaataaggtgcgtagacaagaaaattactttgggagttggagagacttgatgaaaaagctctagctgagagtgtagaaaaccatgattttctaggagtgaaagggaacaatcaatgaaagagaatcctgagggaggttagaagagtgtgataattcatcttgagcagcaggaaggacagctgtgttgggaagtaagaagagtgctgctataaataaaattatgcgtgttagaaaaggacaatagatgaagttgatttcttctcacctaataatctcaatttactctttgagctgagggctaaaacaaatagtcttccgagaaaagtggtggatggggagcaggagagagaggaagaagctttagcagaatagaaaaggggctgattagccaccatgggaataggagaagatactaatcaggttcatgcaaaaagagggtagaggaaaataattttagactggagatcattaatttccatttgtgccatttcaaatacacactagtatttcaacaggataattgagccatttggatagtaagaaagaaaacctgttgtggacttaacctgcgattagggccttgccaggctggtgtagcaggagaatggagaacaaagaagttgtgtattcttgtgtaagagtggataatttggccaactatttaatctgggttagacacaggaggaaataagatgagggaggatgctatgtgagactaggagaaatggaagcatttagatattgaaggtttctggaaatgtatggtgcaagttagtatagtgcaatttgtagtgaagctcagtcattatgttagagaaagaaaaccatttgaagagttaggaattgatgagggttggcagatagtacaaaattgaaaaatactggaataagaaataggttaatggattcagattatcagcagaagtgaatgctgttagttgctgcatatgaagttgctttggaaaagtgcaaaactgcgataccttttttatatcatttcatgttttataaatgaaatcatctttgactcctcaagcagtcttcaaaattgctcaattccatatctgacttttactttaaattctaatctaatagggtgaccaactattccctttgctttggactgtcacaggtttagcactgaaaatactatgtcccaaaaaaccctcagtcacaggcaaacctcaactgttggtcttcctacatactcccaaagtgatttggattccctgtgtcccatttcttcaattcatcttccacatggttgccagcgtgacctttctattttttatgtattcatttttaaagtattatttatttttgagatggggtcttgctctatcacccaggctggagtgtagtggtgcaatctcaactcactgcaacatctgtctccccggctcaagcgatcctcccacctcagcctcctgagtggctgggaccacataggcgtgccaccgcacccagctaatttttttgttttatatttttttgtagagatgaggtttcaccatgttaccgaggctggtcttaaactcttgagctcaagcgatccacccacctgggcatcccaatgtgctgggtttacaggtgtgagccaccacacctggccagcagcctgatctttctaaaacacaagtatgatgatatcgcatctcttcacagaatcctttgatgattcatcatgaagtgcattaaaaatatttcattaaaaatctttcatgacccggtaacttctacctttatagtctcttttccctttcactaccttccttcaatcatacctcccatttcaccctccccaccatgttatcctattcaccaggtgggatagaattattatttttcctttagatatatcattcatttttatactttggaaaccttggatgttatttatccatccctggaaacctttccgatcttttcttctccaaaatcctgcccattcccaaaactgcttattaaaaaattgacttccaatctttccattctatgcaggctttatttctgcttccacagaaatgtctttgttacctctttcatgaaatgtttctgaaatccgttatggttagttacttatggctatcacatgtgactgtaaacttattgaaggcaacaaccatggattatttttctctggaatttcccattccactccatcatcctttgcaattagcatataggacacccacatagcagaatgtctacttggatgaaatcacaaactgttaagattcagatgaattatactaataataaccagtaaaaacggtcatgcttctggagaatttttgaagagatcaacttgacctcacctttgaaaggtcactaggatttaaagagaacaatcgataattcagacaaagtgaggttaactttaagtttatctcttccccagccaccctctttatttttctctccatcagcggcagaaaacggggacggggtggagagaaaaataaagatggtgatgaggtaagagataaagttaaagtttacctcacatttcctaaagtatccattgttctatttaaatcctatatgttatctttagcagctaaaatagtactggtatctctcctaattaattcacaggaatgatgctgtgccaacactgagggattctcatcacctgtgccattcacttcaattgttgctattcactgattgtgatgttagagatttttaaatgttacccctatggggaccataggctcttggccctctcaaggttgctacaaaatcactggcatgaggcagattgattaacatgagataaggaattacaatttatttaaagtatatacacatgagccttcagaatgaagactcaatttcccaataggtaagaaaagcttatataccatcttgaaattacagaataaatgtgaactcagagtatgttcaaaaacagtttttggtggcaagacaagttattggagaaaggaagtaagaggcttggtaacagagttggccttgttatagatgaaacctatgtcagagagaacagatggtaaatgtttcttttccaacttttaaagatgtcaggctcaatctctcctggatctgagaaaagcatagaatggggaggcatggctacattcatggagattctttgcaaatgcaaattttccccacctcagtctgtgagccctgaggcaatgatctcaaaatattttaaagaaatatattttagggtaaaatatttttatttccttcacctttaaaagataggaagtttctcagggacacagatcgttgtggatgattctatattctccatagaacctagcaaatagctcataggatggggcttattgaatatatactgattgagtgtgggctttaaagcagccaaagtcctcaaaaagccatggaaaaggaaatagagttatttccctttatgttttcttttcaaatgcagagagctttagtgattacagacgcagcctcctcactcccatgtgtaggtggataacaagtcattttctgatttccttcacagaatgacaaccaagaaaaataaaaggttgagataactttgaaagcaaatcatgaagctgtccttttcttgaggtccagataatagtattgatggtaccctgagaccttggactgtgctagtttctacccataggatatgtctgaccacctgtgatttctaaattgatttcttttctcttttctcaggtctctacaggtattgcttttctgaggtgaaaaggataggtgcagggaatattgataggagaagcccaagtcagaagacaacattttagggaaatagtcggcatcagaaatgtactagttgatatatcaaggtttttaatttatgcttaatacttctaaacagaaactttgaactattgtttaagcagttcagttcaattatactttttatatgttctttgaatgcttactaggctaggtcctggctatatggtgatgaaaaaaggagatctttttgtggcactgatggacttaagagcacagtgagggtaataaccaacaaacaaattaaaaaaaaaaaccctaaattacaaatgttgatgctaaaaagagaaagaacagagagtgtgagagtgtgtaatgatgtataggattacctagatcgagtgagtggttaaggtctcttagacccacagattgagattaaaaggaaccagagatgtgaattttgtgacctcagcaccacttatttaacctctttgagcctcaattttctcatctgcaatgtggaaataatcacaggactcctgtgaggatggatgacataatgaataaagtgtttagcctgtaaataaaaggcagccctaaataagtggtagccatacttaatgttaatgttagacatggtatggagaatgaactttaggggaaggactggaatgtaaacagtttagtaagggagctgttgcaatagccaatagggttgatgacagcagcctggattaggatggtgacagtagaggtggagataggttagagaggattttacatggaaggaagaattacctgggttttctgggtttttattgtctatgggaggaaatatagtggcaaaggtcagaattactccctaatttctagcttgagtgtctgggaggggagtcaggtcactgactgaaaagggaagcacagattcaggaatgaatcaccaatcccacatccctatgagacaggaaccaagaatatgtccagattggaggggagagaaattggcaacacaaagggagcaaactgcccacaagtaggcaacaatagagccagactcatagatagaggaagagaaagacacacacacacacacacacacacacacacagagagagagagagagagagagagagagagagggatggggtgagggaacagagagaaggaatatactctgattttagtccttccatccaggattttcttgttagtggcttcttagcttctcctttcttatatttcagaaatgacacaattgtccatagcaagctaagtgttccctctaagagagtctatgtttctgctcaaccccaaataaataccttctgcctctcctcatcacggggattttacatctaatggtcactaagaagatttgggggaaaaaaagcccttcttaccttcccttcagtctgaagcaaaaaagaggtttttggaaacaagccatgcaaatctctacgctcacaatgaactgtgaattgcagaagcataagaacccacatttaaaaaataaaaaaggtgtaaacttgacctctagcttgctgttctggcataattgggctctgttatttaacagggaggtgtgaacagaacatgcccattttgtaagtgaaactttctgcaccagtgaagctaaaacaaatagccatttcttttaagtgcaaaagtggaagtgtgactgcaggagagtaaggttatgaacaattcttagttattgaaattgtaatgcactgatggatctttctttgctctctcactgcctgtgtgtggacaatagttgatagtagaagcagtgccaacactaaaatcaaagtaggtggtagggtgggaacagtgtggcataagtagggacaggtgtttacttctattctgattgtccaactagacgaattctagtgttatataagttcctactatgggattagaatggttctgccacaatgtgctcttcacatgtcacagtgaaatcgaaataatgtcttttgtagcaacgtggatggagctggaggccattattctaagtgaagtaacacaggagtagaaaaccaaaaaccaggtattctcacttataagtgggagctaagctatgagcatgcaaaggcatgtggagtgatagttaagacagccaaattctactaagtagtctctcctagtcagggagaggaaagtggcatagtggaaataccacacgcttcagagcaagccaggaatgatagtaaatcctatctttaccattttctagctttgctacttaaggcaatttactgaatgcctctgaagctcagttttttcatctagatcatagggtgataatagttcttacatcttaggacagttgtgaaaattaaattaaataaatacacctgaaaacttccattacagattttgggatacatccttgatcgtcaccacatgataattatttcctgcctttccatttgtgagagtcccttccaccctccattctaagtaacacatacataagcaagatgactgcatgactgtttaagatgtatcacaaataagagggcaaatagggagatggaatagaatgggggaaagcaaaagttttatttacagtaacagcagctcataacagccacactcttttatctgtgaattcatcacttgaggctctgtttttgttagcacagctctatttcctggagcaggacttaatatgacaggaagccattctgctactcatgaggagaatctaaaaccaggttacttctttgctttttgtaaacttactttaaacaaaacaaaaaaaaaaacaataaacaacagaaacccttccccatctgagaaacaacctcagtacattgttttttttccacttctagctcgaaatacagtaaacattcctgcaatatgcacagaaggtatgcttgtgaactttgtcatggggagaaaaacaaagatgaggagaagggtgtgcatggaagcaaggtcccttgtcctcccatttcgagtctcagatcttccattaatagctgtgtggccataataaactcctctctctgggccttgcttctatctatattatgtggagagtgaatttgatgatttccaaaggtccttcccagtctgaaattctacaagatagttaaagcaaaatgaggaatctgttgctctcctaccattcttatctgcaggcaatcagcataattccatgcctagcctctgataatctctaaagattactctactctctctataccttaatataacacataataaaaaccatactaaatcataaaatatgattaaggaagtccaaaaaagaaggaatctcttcataatgattactttaatgaataaagaaagcattacattttaaactgtcttcaaaaatggtttcagtggccctgttttgctagtgcccaaagcattgctagtgcccacaagcattgctagtgcccaaagtattgtgactgttggataatatgccatgtgaatgttgccacaccaatacaggattctacttagaggtagaattggtcttttcccctccaagattatatgaaggaaaatactctattttagcttctaaattcatgtattattaaagctttttatgtaaatttggatacccaagcctagggagagagacaaactgcaggataacctagagtcacaagttattatgatagaataatgaggccacattctcaggtcttgaagatcagccgggacactgacaatgcaggcttaaggaggcaggacaatttttcaagtgatggggttccaagataagaagccaggacccaaagagcaaaatggcagacaaaggacagggatgggaacctaaaaagtgaggctaaatttctactactgcaattaggagtgagcagtatttattctaaccagggctttggacaagacaaatttggagtcaaaataaatataatcgaattctatgctgtttttgctgtggtcagaataaaagatttaacatttcaagacatcttagcctgcaaaatacaacttagagaatctggggtggagggtgcagttgtgggacaattttatggttccttaactgttacattgggtgactttggatcagtactatattttccttgagcctctaattctttatatgtaaacatgtctcttctaattctaatagtctgtgcctctgtaagtataaaagagagatctaggtgttaactaaagaactaattaaccattttactctttattttgttttactttgggcaggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaaaattaagatatctctttaattacgcctttgtttacctacgttccttgtctttttccaaaggccagaattgtcaaccaatttctttaattgaacattgtaaaaaacaggaataagtacttttgtgtaatattcacagtcaacaggggtgtgatggtgaaggcagagtgtgaaaaacgtgagagaggaagagaaaatagatttacctgattcctctttaaaattcaagccactttcttatttaagaaacctagatcaagtttttacagatgtaaataaaagttgaatagtttaccttaaatttttttcaataagtaagttattgttaataatgcacagtaaatatgtgaatttttcctagatgtaaaaaaaaaaatctttcatataaagaccttaaattctg

SEQ ID NO: 5748 - DNA, 15450 bp, human
gccgccagagtaaagctttctaccctttactccctgcaaagaaacaagagtgcttatcccagctaagctccagggtaagttaatgcctagcacctggggattggtggtttcatgtgggaagattggtgtgatcataaaaatcagaacagaggtggatgtggggccagtgtctgtattaaaattgtcactggtttctcatctcagacatcttacaacaggagcaaagataattactgttgagtttgaccagagtccaaagttaacgttaatgccatcagtcctcttcattatgccaggagcatggagtctgtgatgcagctcactctttgatgagggctctttagagagtgggaccagagaagatggcacaaagtggtaagaagagtatattcagtgagactcattgggacaacttgacatattcggccaataaaagtcaatttaattttttatggtgtataatttatctagctgcatcgtgaaggaagatttttgggtataaaatccttgctttggaaaatttagctttcagagatactgagacaaatagtagaaagcagggtaatagattctgggggctgaaagggcccatagagatccaaatccctcacaatacagtcaggaaaactgagagccagtgaagtgaagacacttaggttcactcagcttgttagtggtataggtggatctaggacctgtgtctttaaactcatgtttgccttttcctacagcagtttgcatctcccagagaatactgtaaatttatttgtgaccctgccattttttaggataggaaaggagaaagtatcccagatgacttcagagtctggtcagagtggttccttgatcctttgaaagctaattttgaccgaagttcagccttactggatagcaaagcccatgagtgaggcactcattttttcagttattattgctattactctgaatactagcacctctctccttctgagctaagatgactaaatcaaaaggagactttcagctaaggagtccctgaagggagactgtgccaaatcatttggaaccaggataaggctggatagaatgataccagatttggctgtgctttccaggggagtaggctcagttccaagaatcctgcaagtgagaatatttttatttcagttgttcaaatggatgtgtggagtcattatgatgtatattaattggagaatctatctcttagcaattgcagcacagtaaaattaaccacttatgaaagtaggtgatatgcagatatactgaggtggaaaatggtgtaaactacagtcagaatcagatcacacatttggggcaattgtttttgcaatggttcctgttgaacacagattctttggccaaatgcagtttattttggggctcaactgggaaagttgtagagttcaagttgtacagactactcaaatctgaagacatcaaatgaataaacacatttatgggttgttttggtttgaaataagtgagttggggttttaaaagacaggccagcctgctgggcttggtggctcacgctgtaattccagcattttgggaggccgagacaggtggatcacctgaggtcaggagttcgagaccagcctggtcaacatggcgaaaccccgtttctactaaaaaatacagaaattagctggttgcagtggcaggcgcctgtaatcccagctactgggcaagctgaggctggagaatcgctcgaaaccgagagatggaggttgcagtgagctgagactgtgccattgcactccagcctgggagacagaccaagactctggctcaaaaaaaaaataaaaaaaagataggctgcctatctatactatagctctctgtcatggctcaagcaaagagaacaaagctgtttatagtaaaatgagactttctaaaagcactaacaatcagggcaatggttccccggtggtctatgatttattttaaaagcttttggcaaaaaggtttatttattcttcagatcagtatattttgtggagaagttttctcctagtatcagttcatatacatcacaggtagagtgatcaaatagatagatcaatacataaggagtcagaagtctgtgttatagttcaagttctgccaatgactggtgtggccttcggtgagttatttcatttctgtgcatctcaataatctcatctattataatgggagagggcttggaatagatggttcctaatttccttcctagcaatccaatgatttgagttagactgttagatacctaagaatagttaaatgttatggagtggtgaataatggggccataatagggaaatctatctagagaggacattctggaaatgtagttcagatctccaagagaactgagtatcctttcccaattgccattatatttctttcaggtaatgttatcatgacagcttcaacttttagaccacaggcaaatgctttgtaagtaatttcccttttttaaaaatgagaaaatgcaagacaaaagataaaactttctgaaatctaatttccacagtgacaatgacactcagttggcatttctcaatcttttaaacccaaggttccctttgagaaacgtaaacatttcactacaaggttactgtgaacttgccttcctagggaccagaccctggacttgtagaaaaatctgctccatcacattgacattttccaagtactaagtgcccaacagttaagaggattttgtagatctgtactttcacagtttgtattgtagaaacaataatgacattttttattttgttttccaaatatatttgttataataaggaatatgttttatcaagtaacacttattttctaccctttaactttaaaaattactgctctagatattctagtcctctgctacaactacacttcttaggggattttctaaatccagaaatgtacaggatccaaccaaaggcccttggagatgactctgtgtacaaataaagaggaaatgaactcacatttatttaatacttattgggtatcagacatgaaaataggtacttttacacacattttctttttttcatttctatttcaatattttttgaactacaagtgtttttttctgttgcatgggtaaattatatagcagtaaattctgagatttttagtgcacccaccacctcagtagtgcacgttgtacctaatgtgtaatatttttatgcctagcctgtctcacccaccctcttctgagtctctagattccattatatcactctgtatacctttgcataatcatagcttatctgtcacttataagtgagaacatctattttttttatttttcactcctgtgttactttacttagaatagtggactccacctccatccaagttactgcaaaaatacattattgcgatcctttttatggctgaggagtattacatagtgtatatacaccacatttactttatccactcgttagtcaattggcacatagattcattccacatctttgcaattgtgattagtaggattgctgtatcaaatggtagatttacttgtagctctttaaggaatctccatactgttttctatagaagttgtactaatttacatttctaccagcagtgtagaagctttctcttttatccacatatctaccagcatctatttttttttcactttttaataatagccattcttgcagtaacgtgctattttattctggttttaatttgcatttctctgacgattagtgatgtggagcattttttcgtgtttgttggccatttgtatatcttcttttgaggaatctctatttatgtcctttgcccactctataatgggattatttctctttctattgctgacttgtttgagttccttgtagattctagtttctagtcctttgtcagatgcatagtctgcaaatattttctctcattctgtgggttgtctgtttactcggattattattttcagacacatttttctttaatgctcaaaacaaattatgtggcaggaaccattctaattttacaaaagaggaaactgaagcctggtgatatgaagtgaattgtttcaggccagagaaccgacaattgagacatgatatgataccaggtcttccaaagaacatgattatttccacccataaaatgctgccacagctgcaaaaatgatatctaattaggccgccttcctaaatgattgaaagtccaatacatattcctgcatgaaagttcaaattcaaactttaagttgttgttttgttaatggtctaattgctttaattcattttaaggataaaaataattttcacttcctctaacagaagaaaatgtctgtacttgcagaatgtgtccaaatttgtgtgtatctcatgtcaaccaggcttatttggagttgatgtagatttattcaggaaacagcagagtttccaattctagctgctactctttggttctggttgtaagcggctgaatgaagaacaccggggtcatggagatcagattggcttggataattcatgtgaaatttagtggttaaaaaataaaagaaaaaggtaagatgaggcaaagcaagttaagttcccagatgacatgtaaaagttatcctctagagagtgggaggggcccccatcagcaacttgttttctctgtttaattttttcttcccctcccaggatgacaagcccacagacaggcttcagcatcaaataaaatggagaagtaaatttgataaacatgtttacttagtggtgccagtgacttactgatgagtggtgaaaagacagggaagattgagagtgaagatttatggagttggtaccagctgcataaatggtggcagtgtcaatggtgatgatattagttaggagcagggttcagagggggaattctcatgaaatcataccaaatgagagctagaagggagttaaaggtcatctagttcaaatcatattattttaataatgaggaaatgaaactcacagaagggaaagagcgtatcagagcagcacaaagagtatataaaattactgaaatccaagtatcttagctacaaatccagtacacctttctatatattatactgcttttgagtcttctgtatcctacagcaagtcttgtcctattcagatcactcctgttgtaaagaaattgttccattacttctatctacagatttgttataatttgaattcataagcacaattccataaagaacgttggttttgatataatcctatcctgacacctggtgggcagcaatttgccatatatgcatagtgcatatgcataaaactgctagaactagaaccgaaaacaatagcttttttatctctgaggaacagtcttatccacagaaataccactttaaaatatgtttctgtccatataataagttattcagctaaaaataactttagctttctgggcttatgaaaagccttattaaagctgaaatcataactctgactgcagaaagtcacttactcctgctgagactccattttctaatctgtaaaggagtataatagtaattaactcagaattcttacaaagattagaggtaacgtgaatagcacttagctagttactgacaggatgtggaaatttcctcactgggacttaggaaactaatataaattctgatgccataataatataagctcagtttggctgtaactttgtgaaaaccacaacgttgagctagttggttgggaagagcagctgcttttgggtagatggtattagtatctagtaagattttgggctcagctccaatgaatcatatttaaagaccttccatacctttgtattctgagaaaacatttagttgtttccacaaaataaagttttcagtgatcaaattcctaattaagtttaagggattcctgttggatttcaaaacgaaagctggattgccttctttaaagctcttaggtgttcagatttcttagactaaaaccttattattcttgctttgaccacattttcttcagtagcagaaaggagaaagattatggctgttgtttaggagagtgtttcatgggagagactttacaagtaaaaatgcctaatgctctgctaatatgtgcctatgctctgtagtcttaccttctcacagtgcagcctataaattcagtaggtgttcgaagaagaggggagtgagagtagggttgcccgatgtaaggaaaaaatgggagttgagatgcgatattgagacagaagtaaaatattgacctctgagttgggctccaggtaaaaaaggaatatgatggagttttagtcataactttgtgcgtgccatttttattatcaggaacatctttagagccatactttgatttttgtttttttgcccatattttcttcaacttttattttaagtttaggggtacatgtgcaggatgtgcagggttgtgacataggtaaatgtgtgtcatggtcgtttgctgcaaagatcatcccatcacctagttattaagcccagcatccattagctattcttcctgatgctctctctcacccaacagctcccaacagactccaatgtttcttgtttctcaccatgtgtccatgtgttcccatcattcagctcccacttataagtgagaacatgtggtgtttggttttccattcctgcattagattgctaaggataatggcttccaactccatccatgtccctgcaaaggaaatgatctcattctttttatggctgtatagtatttagagacacactttgtaagtgaatcctgttatttcagagatggtggctgatttttctgcttttcttattaggttaaaactctatgctggtcattcccttcaggatttggcactcaccaacatacccttctttcaagtgaaaaggcatctcttttaatggtcctgacctttggaataggaagcatgtaccctggacagagcacttcaaactagaggtaccaagagtaattacttctgtaaggctggcattggaggcactgggaattctattctcacctctttctgggtaattcaaagccacagaagtactgactgaagtgaggttgtggggacatgtatgccaccttgaagtgcattaaagaatggatataaagtgaggaaaagaaaaaaactggtgtaaacaactatggagagaagggcaggaaggcaacaaagagctagaataaggtgcgtagacaagaaaattactttgggagttggagagacttgatgaaaaagctctagctgagagtgtagaaaaccatgattttctaggagtgaaagggaacaatcaatgaaagagaatcctgagggaggttagaagagtgtgataattcatcttgagcagcaggaaggacagctgtgttgggaagtaagaagagtgctgctataaataaaattatgcgtgttagaaaaggacaatagatgaagttgatttcttctcacctaataatctcaatttactctttgagctgagggctaaaacaaatagtcttccgagaaaagtggtggatggggagcaggagagagaggaagaagctttagcagaatagaaaaggggctgattagccaccatgggaataggagaagatactaatcaggttcatgcaaaaagagggtagaggaaaataattttagactggagatcattaatttccatttgtgccatttcaaatacacactagtatttcaacaggataattgagccatttggatagtaagaaagaaaacctgttgtggacttaacctgcgattagggccttgccaggctggtgtagcaggagaatggagaacaaagaagttgtgtattcttgtgtaagagtggataatttggccaactatttaatctgggttagacacaggaggaaataagatgagggaggatgctatgtgagactaggagaaatggaagcatttagatattgaaggtttctggaaatgtatggtgcaagttagtatagtgcaatttgtagtgaagctcagtcattatgttagagaaagaaaaccatttgaagagttaggaattgatgagggttggcagatagtacaaaattgaaaaatactggaataagaaataggttaatggattcagattatcagcagaagtgaatgctgttagttgctgcatatgaagttgctttggaaaagtgcaaaactgcgataccttttttatatcatttcatgttttataaatgaaatcatctttgactcctcaagcagtcttcaaaattgctcaattccatatctgacttttactttaaattctaatctaatagggtgaccaactattccctttgctttggactgtcacaggtttagcactgaaaatactatgtcccaaaaaaccctcagtcacaggcaaacctcaactgttggtcttcctacatactcccaaagtgatttggattccctgtgtcccatttcttcaattcatcttccacatggttgccagcgtgacctttctattttttatgtattcatttttaaagtattatttatttttgagatggggtcttgctctatcacccaggctggagtgtagtggtgcaatctcaactcactgcaacatctgtctccccggctcaagcgatcctcccacctcagcctcctgagtggctgggaccacataggcgtgccaccgcacccagctaatttttttgttttatatttttttgtagagatgaggtttcaccatgttaccgaggctggtcttaaactcttgagctcaagcgatccacccacctgggcatcccaatgtgctgggtttacaggtgtgagccaccacacctggccagcagcctgatctttctaaaacacaagtatgatgatatcgcatctcttcacagaatcctttgatgattcatcatgaagtgcattaaaaatatttcattaaaaatctttcatgacccggtaacttctacctttatagtctcttttccctttcactaccttccttcaatcatacctcccatttcaccctccccaccatgttatcctattcaccaggtgggatagaattattatttttcctttagatatatcattcatttttatactttggaaaccttggatgttatttatccatccctggaaacctttccgatcttttcttctccaaaatcctgcccattcccaaaactgcttattaaaaaattgacttccaatctttccattctatgcaggctttatttctgcttccacagaaatgtctttgttacctctttcatgaaatgtttctgaaatccgttatggttagttacttatggctatcacatgtgactgtaaacttattgaaggcaacaaccatggattatttttctctggaatttcccattccactccatcatcctttgcaattagcatataggacacccacatagcagaatgtctacttggatgaaatcacaaactgttaagattcagatgaattatactaataataaccagtaaaaacggtcatgcttctggagaatttttgaagagatcaacttgacctcacctttgaaaggtcactaggatttaaagagaacaatcgataattcagacaaagtgaggttaactttaagtttatctcttccccagccaccctctttatttttctctccatcagcggcagaaaacggggacggggtggagagaaaaataaagatggtgatgaggtaagagataaagttaaagtttacctcacatttcctaaagtatccattgttctatttaaatcctatatgttatctttagcagctaaaatagtactggtatctctcctaattaattcacaggaatgatgctgtgccaacactgagggattctcatcacctgtgccattcacttcaattgttgctattcactgattgtgatgttagagatttttaaatgttacccctatggggaccataggctcttggccctctcaaggttgctacaaaatcactggcatgaggcagattgattaacatgagataaggaattacaatttatttaaagtatatacacatgagccttcagaatgaagactcaatttcccaataggtaagaaaagcttatataccatcttgaaattacagaataaatgtgaactcagagtatgttcaaaaacagtttttggtggcaagacaagttattggagaaaggaagtaagaggcttggtaacagagttggccttgttatagatgaaacctatgtcagagagaacagatggtaaatgtttcttttccaacttttaaagatgtcaggctcaatctctcctggatctgagaaaagcatagaatggggaggcatggctacattcatggagattctttgcaaatgcaaattttccccacctcagtctgtgagccctgaggcaatgatctcaaaatattttaaagaaatatattttagggtaaaatatttttatttccttcacctttaaaagataggaagtttctcagggacacagatcgttgtggatgattctatattctccatagaacctagcaaatagctcataggatggggcttattgaatatatactgattgagtgtgggctttaaagcagccaaagtcctcaaaaagccatggaaaaggaaatagagttatttccctttatgttttcttttcaaatgcagagagctttagtgattacagacgcagcctcctcactcccatgtgtaggtggataacaagtcattttctgatttccttcacagaatgacaaccaagaaaaataaaaggttgagataactttgaaagcaaatcatgaagctgtccttttcttgaggtccagataatagtattgatggtaccctgagaccttggactgtgctagtttctacccataggatatgtctgaccacctgtgatttctaaattgatttcttttctcttttctcaggtctctacaggtattgcttttctgaggtgaaaaggataggtgcagggaatattgataggagaagcccaagtcagaagacaacattttagggaaatagtcggcatcagaaatgtactagttgatatatcaaggtttttaatttatgcttaatacttctaaacagaaactttgaactattgtttaagcagttcagttcaattatactttttatatgttctttgaatgcttactaggctaggtcctggctatatggtgatgaaaaaaggagatctttttgtggcactgatggacttaagagcacagtgagggtaataaccaacaaacaaattaaaaaaaaaaaccctaaattacaaatgttgatgctaaaaagagaaagaacagagagtgtgagagtgtgtaatgatgtataggattacctagatcgagtgagtggttaaggtctcttagacccacagattgagattaaaaggaaccagagatgtgaattttgtgacctcagcaccacttatttaacctctttgagcctcaattttctcatctgcaatgtggaaataatcacaggactcctgtgaggatggatgacataatgaataaagtgtttagcctgtaaataaaaggcagccctaaataagtggtagccatacttaatgttaatgttagacatggtatggagaatgaactttaggggaaggactggaatgtaaacagtttagtaagggagctgttgcaatagccaatagggttgatgacagcagcctggattaggatggtgacagtagaggtggagataggttagagaggattttacatggaaggaagaattacctgggttttctgggtttttattgtctatgggaggaaatatagtggcaaaggtcagaattactccctaatttctagcttgagtgtctgggaggggagtcaggtcactgactgaaaagggaagcacagattcaggaatgaatcaccaatcccacatccctatgagacaggaaccaagaatatgtccagattggaggggagagaaattggcaacacaaagggagcaaactgcccacaagtaggcaacaatagagccagactcatagatagaggaagagaaagacacacacacacacacacacacacacacacagagagagagagagagagagagagagagagagggatggggtgagggaacagagagaaggaatatactctgattttagtccttccatccaggattttcttgttagtggcttcttagcttctcctttcttatatttcagaaatgacacaattgtccatagcaagctaagtgttccctctaagagagtctatgtttctgctcaaccccaaataaataccttctgcctctcctcatcacggggattttacatctaatggtcactaagaagatttgggggaaaaaaagcccttcttaccttcccttcagtctgaagcaaaaaagaggtttttggaaacaagccatgcaaatctctacgctcacaatgaactgtgaattgcagaagcataagaacccacatttaaaaaataaaaaaggtgtaaacttgacctctagcttgctgttctggcataattgggctctgttatttaacagggaggtgtgaacagaacatgcccattttgtaagtgaaactttctgcaccagtgaagctaaaacaaatagccatttcttttaagtgcaaaagtggaagtgtgactgcaggagagtaaggttatgaacaattcttagttattgaaattgtaatgcactgatggatctttctttgctctctcactgcctgtgtgtggacaatagttgatagtagaagcagtgccaacactaaaatcaaagtaggtggtagggtgggaacagtgtggcataagtagggacaggtgtttacttctattctgattgtccaactagacgaattctagtgttatataagttcctactatgggattagaatggttctgccacaatgtgctcttcacatgtcacagtgaaatcgaaataatgtcttttgtagcaacgtggatggagctggaggccattattctaagtgaagtaacacaggagtagaaaaccaaaaaccaggtattctcacttataagtgggagctaagctatgagcatgcaaaggcatgtggagtgatagttaagacagccaaattctactaagtagtctctcctagtcagggagaggaaagtggcatagtggaaataccacacgcttcagagcaagccaggaatgatagtaaatcctatctttaccattttctagctttgctacttaaggcaatttactgaatgcctctgaagctcagttttttcatctagatcatagggtgataatagttcttacatcttaggacagttgtgaaaattaaattaaataaatacacctgaaaacttccattacagattttgggatacatccttgatcgtcaccacatgataattatttcctgcctttccatttgtgagagtcccttccaccctccattctaagtaacacatacataagcaagatgactgcatgactgtttaagatgtatcacaaataagagggcaaatagggagatggaatagaatgggggaaagcaaaagttttatttacagtaacagcagctcataacagccacactcttttatctgtgaattcatcacttgaggctctgtttttgttagcacagctctatttcctggagcaggacttaatatgacaggaagccattctgctactcatgaggagaatctaaaaccaggttacttctttgctttttgtaaacttactttaaacaaaacaaaaaaaaaaacaataaacaacagaaacccttccccatctgagaaacaacctcagtacattgttttttttccacttctagctcgaaatacagtaaacattcctgcaatatgcacagaaggtatgcttgtgaactttgtcatggggagaaaaacaaagatgaggagaagggtgtgcatggaagcaaggtcccttgtcctcccatttcgagtctcagatcttccattaatagctgtgtggccataataaactcctctctctgggccttgcttctatctatattatgtggagagtgaatttgatgatttccaaaggtccttcccagtctgaaattctacaagatagttaaagcaaaatgaggaatctgttgctctcctaccattcttatctgcaggcaatcagcataattccatgcctagcctctgataatctctaaagattactctactctctctataccttaatataacacataataaaaaccatactaaatcataaaatatgattaaggaagtccaaaaaagaaggaatctcttcataatgattactttaatgaataaagaaagcattacattttaaactgtcttcaaaaatggtttcagtggccctgttttgctagtgcccaaagcattgctagtgcccacaagcattgctagtgcccaaagtattgtgactgttggataatatgccatgtgaatgttgccacaccaatacaggattctacttagaggtagaattggtcttttcccctccaagattatatgaaggaaaatactctattttagcttctaaattcatgtattattaaagctttttatgtaaatttggatacccaagcctagggagagagacaaactgcaggataacctagagtcacaagttattatgatagaataatgaggccacattctcaggtcttgaagatcagccgggacactgacaatgcaggcttaaggaggcaggacaatttttcaagtgatggggttccaagataagaagccaggacccaaagagcaaaatggcagacaaaggacagggatgggaacctaaaaagtgaggctaaatttctactactgcaattaggagtgagcagtatttattctaaccagggctttggacaagacaaatttggagtcaaaataaatataatcgaattctatgctgtttttgctgtggtcagaataaaagatttaacatttcaagacatcttagcctgcaaaatacaacttagagaatctggggtggagggtgcagttgtgggacaattttatggttccttaactgttacattgggtgactttggatcagtactatattttccttgagcctctaattctttatatgtaaacatgtctcttctaattctaatagtctgtgcctctgtaagtataaaagagagatctaggtgttaactaaagaactaattaaccattttactctttattttgttttactttgggcaggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatg

SEQ ID NO: 5749 - DNA, 15659 bp, human
gccgccagagtaaagctttctaccctttactccctgcaaagaaacaagagtgcttatcccagctaagctccagggtaagttaatgcctagcacctggggattggtggtttcatgtgggaagattggtgtgatcataaaaatcagaacagaggtggatgtggggccagtgtctgtattaaaattgtcactggtttctcatctcagacatcttacaacaggagcaaagataattactgttgagtttgaccagagtccaaagttaacgttaatgccatcagtcctcttcattatgccaggagcatggagtctgtgatgcagctcactctttgatgagggctctttagagagtgggaccagagaagatggcacaaagtggtaagaagagtatattcagtgagactcattgggacaacttgacatattcggccaataaaagtcaatttaattttttatggtgtataatttatctagctgcatcgtgaaggaagatttttgggtataaaatccttgctttggaaaatttagctttcagagatactgagacaaatagtagaaagcagggtaatagattctgggggctgaaagggcccatagagatccaaatccctcacaatacagtcaggaaaactgagagccagtgaagtgaagacacttaggttcactcagcttgttagtggtataggtggatctaggacctgtgtctttaaactcatgtttgccttttcctacagcagtttgcatctcccagagaatactgtaaatttatttgtgaccctgccattttttaggataggaaaggagaaagtatcccagatgacttcagagtctggtcagagtggttccttgatcctttgaaagctaattttgaccgaagttcagccttactggatagcaaagcccatgagtgaggcactcattttttcagttattattgctattactctgaatactagcacctctctccttctgagctaagatgactaaatcaaaaggagactttcagctaaggagtccctgaagggagactgtgccaaatcatttggaaccaggataaggctggatagaatgataccagatttggctgtgctttccaggggagtaggctcagttccaagaatcctgcaagtgagaatatttttatttcagttgttcaaatggatgtgtggagtcattatgatgtatattaattggagaatctatctcttagcaattgcagcacagtaaaattaaccacttatgaaagtaggtgatatgcagatatactgaggtggaaaatggtgtaaactacagtcagaatcagatcacacatttggggcaattgtttttgcaatggttcctgttgaacacagattctttggccaaatgcagtttattttggggctcaactgggaaagttgtagagttcaagttgtacagactactcaaatctgaagacatcaaatgaataaacacatttatgggttgttttggtttgaaataagtgagttggggttttaaaagacaggccagcctgctgggcttggtggctcacgctgtaattccagcattttgggaggccgagacaggtggatcacctgaggtcaggagttcgagaccagcctggtcaacatggcgaaaccccgtttctactaaaaaatacagaaattagctggttgcagtggcaggcgcctgtaatcccagctactgggcaagctgaggctggagaatcgctcgaaaccgagagatggaggttgcagtgagctgagactgtgccattgcactccagcctgggagacagaccaagactctggctcaaaaaaaaaataaaaaaaagataggctgcctatctatactatagctctctgtcatggctcaagcaaagagaacaaagctgtttatagtaaaatgagactttctaaaagcactaacaatcagggcaatggttccccggtggtctatgatttattttaaaagcttttggcaaaaaggtttatttattcttcagatcagtatattttgtggagaagttttctcctagtatcagttcatatacatcacaggtagagtgatcaaatagatagatcaatacataaggagtcagaagtctgtgttatagttcaagttctgccaatgactggtgtggccttcggtgagttatttcatttctgtgcatctcaataatctcatctattataatgggagagggcttggaatagatggttcctaatttccttcctagcaatccaatgatttgagttagactgttagatacctaagaatagttaaatgttatggagtggtgaataatggggccataatagggaaatctatctagagaggacattctggaaatgtagttcagatctccaagagaactgagtatcctttcccaattgccattatatttctttcaggtaatgttatcatgacagcttcaacttttagaccacaggcaaatgctttgtaagtaatttcccttttttaaaaatgagaaaatgcaagacaaaagataaaactttctgaaatctaatttccacagtgacaatgacactcagttggcatttctcaatcttttaaacccaaggttccctttgagaaacgtaaacatttcactacaaggttactgtgaacttgccttcctagggaccagaccctggacttgtagaaaaatctgctccatcacattgacattttccaagtactaagtgcccaacagttaagaggattttgtagatctgtactttcacagtttgtattgtagaaacaataatgacattttttattttgttttccaaatatatttgttataataaggaatatgttttatcaagtaacacttattttctaccctttaactttaaaaattactgctctagatattctagtcctctgctacaactacacttcttaggggattttctaaatccagaaatgtacaggatccaaccaaaggcccttggagatgactctgtgtacaaataaagaggaaatgaactcacatttatttaatacttattgggtatcagacatgaaaataggtacttttacacacattttctttttttcatttctatttcaatattttttgaactacaagtgtttttttctgttgcatgggtaaattatatagcagtaaattctgagatttttagtgcacccaccacctcagtagtgcacgttgtacctaatgtgtaatatttttatgcctagcctgtctcacccaccctcttctgagtctctagattccattatatcactctgtatacctttgcataatcatagcttatctgtcacttataagtgagaacatctattttttttatttttcactcctgtgttactttacttagaatagtggactccacctccatccaagttactgcaaaaatacattattgcgatcctttttatggctgaggagtattacatagtgtatatacaccacatttactttatccactcgttagtcaattggcacatagattcattccacatctttgcaattgtgattagtaggattgctgtatcaaatggtagatttacttgtagctctttaaggaatctccatactgttttctatagaagttgtactaatttacatttctaccagcagtgtagaagctttctcttttatccacatatctaccagcatctatttttttttcactttttaataatagccattcttgcagtaacgtgctattttattctggttttaatttgcatttctctgacgattagtgatgtggagcattttttcgtgtttgttggccatttgtatatcttcttttgaggaatctctatttatgtcctttgcccactctataatgggattatttctctttctattgctgacttgtttgagttccttgtagattctagtttctagtcctttgtcagatgcatagtctgcaaatattttctctcattctgtgggttgtctgtttactcggattattattttcagacacatttttctttaatgctcaaaacaaattatgtggcaggaaccattctaattttacaaaagaggaaactgaagcctggtgatatgaagtgaattgtttcaggccagagaaccgacaattgagacatgatatgataccaggtcttccaaagaacatgattatttccacccataaaatgctgccacagctgcaaaaatgatatctaattaggccgccttcctaaatgattgaaagtccaatacatattcctgcatgaaagttcaaattcaaactttaagttgttgttttgttaatggtctaattgctttaattcattttaaggataaaaataattttcacttcctctaacagaagaaaatgtctgtacttgcagaatgtgtccaaatttgtgtgtatctcatgtcaaccaggcttatttggagttgatgtagatttattcaggaaacagcagagtttccaattctagctgctactctttggttctggttgtaagcggctgaatgaagaacaccggggtcatggagatcagattggcttggataattcatgtgaaatttagtggttaaaaaataaaagaaaaaggtaagatgaggcaaagcaagttaagttcccagatgacatgtaaaagttatcctctagagagtgggaggggcccccatcagcaacttgttttctctgtttaattttttcttcccctcccaggatgacaagcccacagacaggcttcagcatcaaataaaatggagaagtaaatttgataaacatgtttacttagtggtgccagtgacttactgatgagtggtgaaaagacagggaagattgagagtgaagatttatggagttggtaccagctgcataaatggtggcagtgtcaatggtgatgatattagttaggagcagggttcagagggggaattctcatgaaatcataccaaatgagagctagaagggagttaaaggtcatctagttcaaatcatattattttaataatgaggaaatgaaactcacagaagggaaagagcgtatcagagcagcacaaagagtatataaaattactgaaatccaagtatcttagctacaaatccagtacacctttctatatattatactgcttttgagtcttctgtatcctacagcaagtcttgtcctattcagatcactcctgttgtaaagaaattgttccattacttctatctacagatttgttataatttgaattcataagcacaattccataaagaacgttggttttgatataatcctatcctgacacctggtgggcagcaatttgccatatatgcatagtgcatatgcataaaactgctagaactagaaccgaaaacaatagcttttttatctctgaggaacagtcttatccacagaaataccactttaaaatatgtttctgtccatataataagttattcagctaaaaataactttagctttctgggcttatgaaaagccttattaaagctgaaatcataactctgactgcagaaagtcacttactcctgctgagactccattttctaatctgtaaaggagtataatagtaattaactcagaattcttacaaagattagaggtaacgtgaatagcacttagctagttactgacaggatgtggaaatttcctcactgggacttaggaaactaatataaattctgatgccataataatataagctcagtttggctgtaactttgtgaaaaccacaacgttgagctagttggttgggaagagcagctgcttttgggtagatggtattagtatctagtaagattttgggctcagctccaatgaatcatatttaaagaccttccatacctttgtattctgagaaaacatttagttgtttccacaaaataaagttttcagtgatcaaattcctaattaagtttaagggattcctgttggatttcaaaacgaaagctggattgccttctttaaagctcttaggtgttcagatttcttagactaaaaccttattattcttgctttgaccacattttcttcagtagcagaaaggagaaagattatggctgttgtttaggagagtgtttcatgggagagactttacaagtaaaaatgcctaatgctctgctaatatgtgcctatgctctgtagtcttaccttctcacagtgcagcctataaattcagtaggtgttcgaagaagaggggagtgagagtagggttgcccgatgtaaggaaaaaatgggagttgagatgcgatattgagacagaagtaaaatattgacctctgagttgggctccaggtaaaaaaggaatatgatggagttttagtcataactttgtgcgtgccatttttattatcaggaacatctttagagccatactttgatttttgtttttttgcccatattttcttcaacttttattttaagtttaggggtacatgtgcaggatgtgcagggttgtgacataggtaaatgtgtgtcatggtcgtttgctgcaaagatcatcccatcacctagttattaagcccagcatccattagctattcttcctgatgctctctctcacccaacagctcccaacagactccaatgtttcttgtttctcaccatgtgtccatgtgttcccatcattcagctcccacttataagtgagaacatgtggtgtttggttttccattcctgcattagattgctaaggataatggcttccaactccatccatgtccctgcaaaggaaatgatctcattctttttatggctgtatagtatttagagacacactttgtaagtgaatcctgttatttcagagatggtggctgatttttctgcttttcttattaggttaaaactctatgctggtcattcccttcaggatttggcactcaccaacatacccttctttcaagtgaaaaggcatctcttttaatggtcctgacctttggaataggaagcatgtaccctggacagagcacttcaaactagaggtaccaagagtaattacttctgtaaggctggcattggaggcactgggaattctattctcacctctttctgggtaattcaaagccacagaagtactgactgaagtgaggttgtggggacatgtatgccaccttgaagtgcattaaagaatggatataaagtgaggaaaagaaaaaaactggtgtaaacaactatggagagaagggcaggaaggcaacaaagagctagaataaggtgcgtagacaagaaaattactttgggagttggagagacttgatgaaaaagctctagctgagagtgtagaaaaccatgattttctaggagtgaaagggaacaatcaatgaaagagaatcctgagggaggttagaagagtgtgataattcatcttgagcagcaggaaggacagctgtgttgggaagtaagaagagtgctgctataaataaaattatgcgtgttagaaaaggacaatagatgaagttgatttcttctcacctaataatctcaatttactctttgagctgagggctaaaacaaatagtcttccgagaaaagtggtggatggggagcaggagagagaggaagaagctttagcagaatagaaaaggggctgattagccaccatgggaataggagaagatactaatcaggttcatgcaaaaagagggtagaggaaaataattttagactggagatcattaatttccatttgtgccatttcaaatacacactagtatttcaacaggataattgagccatttggatagtaagaaagaaaacctgttgtggacttaacctgcgattagggccttgccaggctggtgtagcaggagaatggagaacaaagaagttgtgtattcttgtgtaagagtggataatttggccaactatttaatctgggttagacacaggaggaaataagatgagggaggatgctatgtgagactaggagaaatggaagcatttagatattgaaggtttctggaaatgtatggtgcaagttagtatagtgcaatttgtagtgaagctcagtcattatgttagagaaagaaaaccatttgaagagttaggaattgatgagggttggcagatagtacaaaattgaaaaatactggaataagaaataggttaatggattcagattatcagcagaagtgaatgctgttagttgctgcatatgaagttgctttggaaaagtgcaaaactgcgataccttttttatatcatttcatgttttataaatgaaatcatctttgactcctcaagcagtcttcaaaattgctcaattccatatctgacttttactttaaattctaatctaatagggtgaccaactattccctttgctttggactgtcacaggtttagcactgaaaatactatgtcccaaaaaaccctcagtcacaggcaaacctcaactgttggtcttcctacatactcccaaagtgatttggattccctgtgtcccatttcttcaattcatcttccacatggttgccagcgtgacctttctattttttatgtattcatttttaaagtattatttatttttgagatggggtcttgctctatcacccaggctggagtgtagtggtgcaatctcaactcactgcaacatctgtctccccggctcaagcgatcctcccacctcagcctcctgagtggctgggaccacataggcgtgccaccgcacccagctaatttttttgttttatatttttttgtagagatgaggtttcaccatgttaccgaggctggtcttaaactcttgagctcaagcgatccacccacctgggcatcccaatgtgctgggtttacaggtgtgagccaccacacctggccagcagcctgatctttctaaaacacaagtatgatgatatcgcatctcttcacagaatcctttgatgattcatcatgaagtgcattaaaaatatttcattaaaaatctttcatgacccggtaacttctacctttatagtctcttttccctttcactaccttccttcaatcatacctcccatttcaccctccccaccatgttatcctattcaccaggtgggatagaattattatttttcctttagatatatcattcatttttatactttggaaaccttggatgttatttatccatccctggaaacctttccgatcttttcttctccaaaatcctgcccattcccaaaactgcttattaaaaaattgacttccaatctttccattctatgcaggctttatttctgcttccacagaaatgtctttgttacctctttcatgaaatgtttctgaaatccgttatggttagttacttatggctatcacatgtgactgtaaacttattgaaggcaacaaccatggattatttttctctggaatttcccattccactccatcatcctttgcaattagcatataggacacccacatagcagaatgtctacttggatgaaatcacaaactgttaagattcagatgaattatactaataataaccagtaaaaacggtcatgcttctggagaatttttgaagagatcaacttgacctcacctttgaaaggtcactaggatttaaagagaacaatcgataattcagacaaagtgaggttaactttaagtttatctcttccccagccaccctctttatttttctctccatcagcggcagaaaacggggacggggtggagagaaaaataaagatggtgatgaggtaagagataaagttaaagtttacctcacatttcctaaagtatccattgttctatttaaatcctatatgttatctttagcagctaaaatagtactggtatctctcctaattaattcacaggaatgatgctgtgccaacactgagggattctcatcacctgtgccattcacttcaattgttgctattcactgattgtgatgttagagatttttaaatgttacccctatggggaccataggctcttggccctctcaaggttgctacaaaatcactggcatgaggcagattgattaacatgagataaggaattacaatttatttaaagtatatacacatgagccttcagaatgaagactcaatttcccaataggtaagaaaagcttatataccatcttgaaattacagaataaatgtgaactcagagtatgttcaaaaacagtttttggtggcaagacaagttattggagaaaggaagtaagaggcttggtaacagagttggccttgttatagatgaaacctatgtcagagagaacagatggtaaatgtttcttttccaacttttaaagatgtcaggctcaatctctcctggatctgagaaaagcatagaatggggaggcatggctacattcatggagattctttgcaaatgcaaattttccccacctcagtctgtgagccctgaggcaatgatctcaaaatattttaaagaaatatattttagggtaaaatatttttatttccttcacctttaaaagataggaagtttctcagggacacagatcgttgtggatgattctatattctccatagaacctagcaaatagctcataggatggggcttattgaatatatactgattgagtgtgggctttaaagcagccaaagtcctcaaaaagccatggaaaaggaaatagagttatttccctttatgttttcttttcaaatgcagagagctttagtgattacagacgcagcctcctcactcccatgtgtaggtggataacaagtcattttctgatttccttcacagaatgacaaccaagaaaaataaaaggttgagataactttgaaagcaaatcatgaagctgtccttttcttgaggtccagataatagtattgatggtaccctgagaccttggactgtgctagtttctacccataggatatgtctgaccacctgtgatttctaaattgatttcttttctcttttctcaggtctctacaggtattgcttttctgaggtgaaaaggataggtgcagggaatattgataggagaagcccaagtcagaagacaacattttagggaaatagtcggcatcagaaatgtactagttgatatatcaaggtttttaatttatgcttaatacttctaaacagaaactttgaactattgtttaagcagttcagttcaattatactttttatatgttctttgaatgcttactaggctaggtcctggctatatggtgatgaaaaaaggagatctttttgtggcactgatggacttaagagcacagtgagggtaataaccaacaaacaaattaaaaaaaaaaaccctaaattacaaatgttgatgctaaaaagagaaagaacagagagtgtgagagtgtgtaatgatgtataggattacctagatcgagtgagtggttaaggtctcttagacccacagattgagattaaaaggaaccagagatgtgaattttgtgacctcagcaccacttatttaacctctttgagcctcaattttctcatctgcaatgtggaaataatcacaggactcctgtgaggatggatgacataatgaataaagtgtttagcctgtaaataaaaggcagccctaaataagtggtagccatacttaatgttaatgttagacatggtatggagaatgaactttaggggaaggactggaatgtaaacagtttagtaagggagctgttgcaatagccaatagggttgatgacagcagcctggattaggatggtgacagtagaggtggagataggttagagaggattttacatggaaggaagaattacctgggttttctgggtttttattgtctatgggaggaaatatagtggcaaaggtcagaattactccctaatttctagcttgagtgtctgggaggggagtcaggtcactgactgaaaagggaagcacagattcaggaatgaatcaccaatcccacatccctatgagacaggaaccaagaatatgtccagattggaggggagagaaattggcaacacaaagggagcaaactgcccacaagtaggcaacaatagagccagactcatagatagaggaagagaaagacacacacacacacacacacacacacacacagagagagagagagagagagagagagagagagggatggggtgagggaacagagagaaggaatatactctgattttagtccttccatccaggattttcttgttagtggcttcttagcttctcctttcttatatttcagaaatgacacaattgtccatagcaagctaagtgttccctctaagagagtctatgtttctgctcaaccccaaataaataccttctgcctctcctcatcacggggattttacatctaatggtcactaagaagatttgggggaaaaaaagcccttcttaccttcccttcagtctgaagcaaaaaagaggtttttggaaacaagccatgcaaatctctacgctcacaatgaactgtgaattgcagaagcataagaacccacatttaaaaaataaaaaaggtgtaaacttgacctctagcttgctgttctggcataattgggctctgttatttaacagggaggtgtgaacagaacatgcccattttgtaagtgaaactttctgcaccagtgaagctaaaacaaatagccatttcttttaagtgcaaaagtggaagtgtgactgcaggagagtaaggttatgaacaattcttagttattgaaattgtaatgcactgatggatctttctttgctctctcactgcctgtgtgtggacaatagttgatagtagaagcagtgccaacactaaaatcaaagtaggtggtagggtgggaacagtgtggcataagtagggacaggtgtttacttctattctgattgtccaactagacgaattctagtgttatataagttcctactatgggattagaatggttctgccacaatgtgctcttcacatgtcacagtgaaatcgaaataatgtcttttgtagcaacgtggatggagctggaggccattattctaagtgaagtaacacaggagtagaaaaccaaaaaccaggtattctcacttataagtgggagctaagctatgagcatgcaaaggcatgtggagtgatagttaagacagccaaattctactaagtagtctctcctagtcagggagaggaaagtggcatagtggaaataccacacgcttcagagcaagccaggaatgatagtaaatcctatctttaccattttctagctttgctacttaaggcaatttactgaatgcctctgaagctcagttttttcatctagatcatagggtgataatagttcttacatcttaggacagttgtgaaaattaaattaaataaatacacctgaaaacttccattacagattttgggatacatccttgatcgtcaccacatgataattatttcctgcctttccatttgtgagagtcccttccaccctccattctaagtaacacatacataagcaagatgactgcatgactgtttaagatgtatcacaaataagagggcaaatagggagatggaatagaatgggggaaagcaaaagttttatttacagtaacagcagctcataacagccacactcttttatctgtgaattcatcacttgaggctctgtttttgttagcacagctctatttcctggagcaggacttaatatgacaggaagccattctgctactcatgaggagaatctaaaaccaggttacttctttgctttttgtaaacttactttaaacaaaacaaaaaaaaaaacaataaacaacagaaacccttccccatctgagaaacaacctcagtacattgttttttttccacttctagctcgaaatacagtaaacattcctgcaatatgcacagaaggtatgcttgtgaactttgtcatggggagaaaaacaaagatgaggagaagggtgtgcatggaagcaaggtcccttgtcctcccatttcgagtctcagatcttccattaatagctgtgtggccataataaactcctctctctgggccttgcttctatctatattatgtggagagtgaatttgatgatttccaaaggtccttcccagtctgaaattctacaagatagttaaagcaaaatgaggaatctgttgctctcctaccattcttatctgcaggcaatcagcataattccatgcctagcctctgataatctctaaagattactctactctctctataccttaatataacacataataaaaaccatactaaatcataaaatatgattaaggaagtccaaaaaagaaggaatctcttcataatgattactttaatgaataaagaaagcattacattttaaactgtcttcaaaaatggtttcagtggccctgttttgctagtgcccaaagcattgctagtgcccacaagcattgctagtgcccaaagtattgtgactgttggataatatgccatgtgaatgttgccacaccaatacaggattctacttagaggtagaattggtcttttcccctccaagattatatgaaggaaaatactctattttagcttctaaattcatgtattattaaagctttttatgtaaatttggatacccaagcctagggagagagacaaactgcaggataacctagagtcacaagttattatgatagaataatgaggccacattctcaggtcttgaagatcagccgggacactgacaatgcaggcttaaggaggcaggacaatttttcaagtgatggggttccaagataagaagccaggacccaaagagcaaaatggcagacaaaggacagggatgggaacctaaaaagtgaggctaaatttctactactgcaattaggagtgagcagtatttattctaaccagggctttggacaagacaaatttggagtcaaaataaatataatcgaattctatgctgtttttgctgtggtcagaataaaagatttaacatttcaagacatcttagcctgcaaaatacaacttagagaatctggggtggagggtgcagttgtgggacaattttatggttccttaactgttacattgggtgactttggatcagtactatattttccttgagcctctaattctttatatgtaaacatgtctcttctaattctaatagtctgtgcctctgtaagtataaaagagagatctaggtgttaactaaagaactaattaaccattttactctttattttgttttactttgggcaggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggata

SEQ ID NO: 5750 - DNA, 16533 bp, human
gccgccagagtaaagctttctaccctttactccctgcaaagaaacaagagtgcttatcccagctaagctccagggtaagttaatgcctagcacctggggattggtggtttcatgtgggaagattggtgtgatcataaaaatcagaacagaggtggatgtggggccagtgtctgtattaaaattgtcactggtttctcatctcagacatcttacaacaggagcaaagataattactgttgagtttgaccagagtccaaagttaacgttaatgccatcagtcctcttcattatgccaggagcatggagtctgtgatgcagctcactctttgatgagggctctttagagagtgggaccagagaagatggcacaaagtggtaagaagagtatattcagtgagactcattgggacaacttgacatattcggccaataaaagtcaatttaattttttatggtgtataatttatctagctgcatcgtgaaggaagatttttgggtataaaatccttgctttggaaaatttagctttcagagatactgagacaaatagtagaaagcagggtaatagattctgggggctgaaagggcccatagagatccaaatccctcacaatacagtcaggaaaactgagagccagtgaagtgaagacacttaggttcactcagcttgttagtggtataggtggatctaggacctgtgtctttaaactcatgtttgccttttcctacagcagtttgcatctcccagagaatactgtaaatttatttgtgaccctgccattttttaggataggaaaggagaaagtatcccagatgacttcagagtctggtcagagtggttccttgatcctttgaaagctaattttgaccgaagttcagccttactggatagcaaagcccatgagtgaggcactcattttttcagttattattgctattactctgaatactagcacctctctccttctgagctaagatgactaaatcaaaaggagactttcagctaaggagtccctgaagggagactgtgccaaatcatttggaaccaggataaggctggatagaatgataccagatttggctgtgctttccaggggagtaggctcagttccaagaatcctgcaagtgagaatatttttatttcagttgttcaaatggatgtgtggagtcattatgatgtatattaattggagaatctatctcttagcaattgcagcacagtaaaattaaccacttatgaaagtaggtgatatgcagatatactgaggtggaaaatggtgtaaactacagtcagaatcagatcacacatttggggcaattgtttttgcaatggttcctgttgaacacagattctttggccaaatgcagtttattttggggctcaactgggaaagttgtagagttcaagttgtacagactactcaaatctgaagacatcaaatgaataaacacatttatgggttgttttggtttgaaataagtgagttggggttttaaaagacaggccagcctgctgggcttggtggctcacgctgtaattccagcattttgggaggccgagacaggtggatcacctgaggtcaggagttcgagaccagcctggtcaacatggcgaaaccccgtttctactaaaaaatacagaaattagctggttgcagtggcaggcgcctgtaatcccagctactgggcaagctgaggctggagaatcgctcgaaaccgagagatggaggttgcagtgagctgagactgtgccattgcactccagcctgggagacagaccaagactctggctcaaaaaaaaaataaaaaaaagataggctgcctatctatactatagctctctgtcatggctcaagcaaagagaacaaagctgtttatagtaaaatgagactttctaaaagcactaacaatcagggcaatggttccccggtggtctatgatttattttaaaagcttttggcaaaaaggtttatttattcttcagatcagtatattttgtggagaagttttctcctagtatcagttcatatacatcacaggtagagtgatcaaatagatagatcaatacataaggagtcagaagtctgtgttatagttcaagttctgccaatgactggtgtggccttcggtgagttatttcatttctgtgcatctcaataatctcatctattataatgggagagggcttggaatagatggttcctaatttccttcctagcaatccaatgatttgagttagactgttagatacctaagaatagttaaatgttatggagtggtgaataatggggccataatagggaaatctatctagagaggacattctggaaatgtagttcagatctccaagagaactgagtatcctttcccaattgccattatatttctttcaggtaatgttatcatgacagcttcaacttttagaccacaggcaaatgctttgtaagtaatttcccttttttaaaaatgagaaaatgcaagacaaaagataaaactttctgaaatctaatttccacagtgacaatgacactcagttggcatttctcaatcttttaaacccaaggttccctttgagaaacgtaaacatttcactacaaggttactgtgaacttgccttcctagggaccagaccctggacttgtagaaaaatctgctccatcacattgacattttccaagtactaagtgcccaacagttaagaggattttgtagatctgtactttcacagtttgtattgtagaaacaataatgacattttttattttgttttccaaatatatttgttataataaggaatatgttttatcaagtaacacttattttctaccctttaactttaaaaattactgctctagatattctagtcctctgctacaactacacttcttaggggattttctaaatccagaaatgtacaggatccaaccaaaggcccttggagatgactctgtgtacaaataaagaggaaatgaactcacatttatttaatacttattgggtatcagacatgaaaataggtacttttacacacattttctttttttcatttctatttcaatattttttgaactacaagtgtttttttctgttgcatgggtaaattatatagcagtaaattctgagatttttagtgcacccaccacctcagtagtgcacgttgtacctaatgtgtaatatttttatgcctagcctgtctcacccaccctcttctgagtctctagattccattatatcactctgtatacctttgcataatcatagcttatctgtcacttataagtgagaacatctattttttttatttttcactcctgtgttactttacttagaatagtggactccacctccatccaagttactgcaaaaatacattattgcgatcctttttatggctgaggagtattacatagtgtatatacaccacatttactttatccactcgttagtcaattggcacatagattcattccacatctttgcaattgtgattagtaggattgctgtatcaaatggtagatttacttgtagctctttaaggaatctccatactgttttctatagaagttgtactaatttacatttctaccagcagtgtagaagctttctcttttatccacatatctaccagcatctatttttttttcactttttaataatagccattcttgcagtaacgtgctattttattctggttttaatttgcatttctctgacgattagtgatgtggagcattttttcgtgtttgttggccatttgtatatcttcttttgaggaatctctatttatgtcctttgcccactctataatgggattatttctctttctattgctgacttgtttgagttccttgtagattctagtttctagtcctttgtcagatgcatagtctgcaaatattttctctcattctgtgggttgtctgtttactcggattattattttcagacacatttttctttaatgctcaaaacaaattatgtggcaggaaccattctaattttacaaaagaggaaactgaagcctggtgatatgaagtgaattgtttcaggccagagaaccgacaattgagacatgatatgataccaggtcttccaaagaacatgattatttccacccataaaatgctgccacagctgcaaaaatgatatctaattaggccgccttcctaaatgattgaaagtccaatacatattcctgcatgaaagttcaaattcaaactttaagttgttgttttgttaatggtctaattgctttaattcattttaaggataaaaataattttcacttcctctaacagaagaaaatgtctgtacttgcagaatgtgtccaaatttgtgtgtatctcatgtcaaccaggcttatttggagttgatgtagatttattcaggaaacagcagagtttccaattctagctgctactctttggttctggttgtaagcggctgaatgaagaacaccggggtcatggagatcagattggcttggataattcatgtgaaatttagtggttaaaaaataaaagaaaaaggtaagatgaggcaaagcaagttaagttcccagatgacatgtaaaagttatcctctagagagtgggaggggcccccatcagcaacttgttttctctgtttaattttttcttcccctcccaggatgacaagcccacagacaggcttcagcatcaaataaaatggagaagtaaatttgataaacatgtttacttagtggtgccagtgacttactgatgagtggtgaaaagacagggaagattgagagtgaagatttatggagttggtaccagctgcataaatggtggcagtgtcaatggtgatgatattagttaggagcagggttcagagggggaattctcatgaaatcataccaaatgagagctagaagggagttaaaggtcatctagttcaaatcatattattttaataatgaggaaatgaaactcacagaagggaaagagcgtatcagagcagcacaaagagtatataaaattactgaaatccaagtatcttagctacaaatccagtacacctttctatatattatactgcttttgagtcttctgtatcctacagcaagtcttgtcctattcagatcactcctgttgtaaagaaattgttccattacttctatctacagatttgttataatttgaattcataagcacaattccataaagaacgttggttttgatataatcctatcctgacacctggtgggcagcaatttgccatatatgcatagtgcatatgcataaaactgctagaactagaaccgaaaacaatagcttttttatctctgaggaacagtcttatccacagaaataccactttaaaatatgtttctgtccatataataagttattcagctaaaaataactttagctttctgggcttatgaaaagccttattaaagctgaaatcataactctgactgcagaaagtcacttactcctgctgagactccattttctaatctgtaaaggagtataatagtaattaactcagaattcttacaaagattagaggtaacgtgaatagcacttagctagttactgacaggatgtggaaatttcctcactgggacttaggaaactaatataaattctgatgccataataatataagctcagtttggctgtaactttgtgaaaaccacaacgttgagctagttggttgggaagagcagctgcttttgggtagatggtattagtatctagtaagattttgggctcagctccaatgaatcatatttaaagaccttccatacctttgtattctgagaaaacatttagttgtttccacaaaataaagttttcagtgatcaaattcctaattaagtttaagggattcctgttggatttcaaaacgaaagctggattgccttctttaaagctcttaggtgttcagatttcttagactaaaaccttattattcttgctttgaccacattttcttcagtagcagaaaggagaaagattatggctgttgtttaggagagtgtttcatgggagagactttacaagtaaaaatgcctaatgctctgctaatatgtgcctatgctctgtagtcttaccttctcacagtgcagcctataaattcagtaggtgttcgaagaagaggggagtgagagtagggttgcccgatgtaaggaaaaaatgggagttgagatgcgatattgagacagaagtaaaatattgacctctgagttgggctccaggtaaaaaaggaatatgatggagttttagtcataactttgtgcgtgccatttttattatcaggaacatctttagagccatactttgatttttgtttttttgcccatattttcttcaacttttattttaagtttaggggtacatgtgcaggatgtgcagggttgtgacataggtaaatgtgtgtcatggtcgtttgctgcaaagatcatcccatcacctagttattaagcccagcatccattagctattcttcctgatgctctctctcacccaacagctcccaacagactccaatgtttcttgtttctcaccatgtgtccatgtgttcccatcattcagctcccacttataagtgagaacatgtggtgtttggttttccattcctgcattagattgctaaggataatggcttccaactccatccatgtccctgcaaaggaaatgatctcattctttttatggctgtatagtatttagagacacactttgtaagtgaatcctgttatttcagagatggtggctgatttttctgcttttcttattaggttaaaactctatgctggtcattcccttcaggatttggcactcaccaacatacccttctttcaagtgaaaaggcatctcttttaatggtcctgacctttggaataggaagcatgtaccctggacagagcacttcaaactagaggtaccaagagtaattacttctgtaaggctggcattggaggcactgggaattctattctcacctctttctgggtaattcaaagccacagaagtactgactgaagtgaggttgtggggacatgtatgccaccttgaagtgcattaaagaatggatataaagtgaggaaaagaaaaaaactggtgtaaacaactatggagagaagggcaggaaggcaacaaagagctagaataaggtgcgtagacaagaaaattactttgggagttggagagacttgatgaaaaagctctagctgagagtgtagaaaaccatgattttctaggagtgaaagggaacaatcaatgaaagagaatcctgagggaggttagaagagtgtgataattcatcttgagcagcaggaaggacagctgtgttgggaagtaagaagagtgctgctataaataaaattatgcgtgttagaaaaggacaatagatgaagttgatttcttctcacctaataatctcaatttactctttgagctgagggctaaaacaaatagtcttccgagaaaagtggtggatggggagcaggagagagaggaagaagctttagcagaatagaaaaggggctgattagccaccatgggaataggagaagatactaatcaggttcatgcaaaaagagggtagaggaaaataattttagactggagatcattaatttccatttgtgccatttcaaatacacactagtatttcaacaggataattgagccatttggatagtaagaaagaaaacctgttgtggacttaacctgcgattagggccttgccaggctggtgtagcaggagaatggagaacaaagaagttgtgtattcttgtgtaagagtggataatttggccaactatttaatctgggttagacacaggaggaaataagatgagggaggatgctatgtgagactaggagaaatggaagcatttagatattgaaggtttctggaaatgtatggtgcaagttagtatagtgcaatttgtagtgaagctcagtcattatgttagagaaagaaaaccatttgaagagttaggaattgatgagggttggcagatagtacaaaattgaaaaatactggaataagaaataggttaatggattcagattatcagcagaagtgaatgctgttagttgctgcatatgaagttgctttggaaaagtgcaaaactgcgataccttttttatatcatttcatgttttataaatgaaatcatctttgactcctcaagcagtcttcaaaattgctcaattccatatctgacttttactttaaattctaatctaatagggtgaccaactattccctttgctttggactgtcacaggtttagcactgaaaatactatgtcccaaaaaaccctcagtcacaggcaaacctcaactgttggtcttcctacatactcccaaagtgatttggattccctgtgtcccatttcttcaattcatcttccacatggttgccagcgtgacctttctattttttatgtattcatttttaaagtattatttatttttgagatggggtcttgctctatcacccaggctggagtgtagtggtgcaatctcaactcactgcaacatctgtctccccggctcaagcgatcctcccacctcagcctcctgagtggctgggaccacataggcgtgccaccgcacccagctaatttttttgttttatatttttttgtagagatgaggtttcaccatgttaccgaggctggtcttaaactcttgagctcaagcgatccacccacctgggcatcccaatgtgctgggtttacaggtgtgagccaccacacctggccagcagcctgatctttctaaaacacaagtatgatgatatcgcatctcttcacagaatcctttgatgattcatcatgaagtgcattaaaaatatttcattaaaaatctttcatgacccggtaacttctacctttatagtctcttttccctttcactaccttccttcaatcatacctcccatttcaccctccccaccatgttatcctattcaccaggtgggatagaattattatttttcctttagatatatcattcatttttatactttggaaaccttggatgttatttatccatccctggaaacctttccgatcttttcttctccaaaatcctgcccattcccaaaactgcttattaaaaaattgacttccaatctttccattctatgcaggctttatttctgcttccacagaaatgtctttgttacctctttcatgaaatgtttctgaaatccgttatggttagttacttatggctatcacatgtgactgtaaacttattgaaggcaacaaccatggattatttttctctggaatttcccattccactccatcatcctttgcaattagcatataggacacccacatagcagaatgtctacttggatgaaatcacaaactgttaagattcagatgaattatactaataataaccagtaaaaacggtcatgcttctggagaatttttgaagagatcaacttgacctcacctttgaaaggtcactaggatttaaagagaacaatcgataattcagacaaagtgaggttaactttaagtttatctcttccccagccaccctctttatttttctctccatcagcggcagaaaacggggacggggtggagagaaaaataaagatggtgatgaggtaagagataaagttaaagtttacctcacatttcctaaagtatccattgttctatttaaatcctatatgttatctttagcagctaaaatagtactggtatctctcctaattaattcacaggaatgatgctgtgccaacactgagggattctcatcacctgtgccattcacttcaattgttgctattcactgattgtgatgttagagatttttaaatgttacccctatggggaccataggctcttggccctctcaaggttgctacaaaatcactggcatgaggcagattgattaacatgagataaggaattacaatttatttaaagtatatacacatgagccttcagaatgaagactcaatttcccaataggtaagaaaagcttatataccatcttgaaattacagaataaatgtgaactcagagtatgttcaaaaacagtttttggtggcaagacaagttattggagaaaggaagtaagaggcttggtaacagagttggccttgttatagatgaaacctatgtcagagagaacagatggtaaatgtttcttttccaacttttaaagatgtcaggctcaatctctcctggatctgagaaaagcatagaatggggaggcatggctacattcatggagattctttgcaaatgcaaattttccccacctcagtctgtgagccctgaggcaatgatctcaaaatattttaaagaaatatattttagggtaaaatatttttatttccttcacctttaaaagataggaagtttctcagggacacagatcgttgtggatgattctatattctccatagaacctagcaaatagctcataggatggggcttattgaatatatactgattgagtgtgggctttaaagcagccaaagtcctcaaaaagccatggaaaaggaaatagagttatttccctttatgttttcttttcaaatgcagagagctttagtgattacagacgcagcctcctcactcccatgtgtaggtggataacaagtcattttctgatttccttcacagaatgacaaccaagaaaaataaaaggttgagataactttgaaagcaaatcatgaagctgtccttttcttgaggtccagataatagtattgatggtaccctgagaccttggactgtgctagtttctacccataggatatgtctgaccacctgtgatttctaaattgatttcttttctcttttctcaggtctctacaggtattgcttttctgaggtgaaaaggataggtgcagggaatattgataggagaagcccaagtcagaagacaacattttagggaaatagtcggcatcagaaatgtactagttgatatatcaaggtttttaatttatgcttaatacttctaaacagaaactttgaactattgtttaagcagttcagttcaattatactttttatatgttctttgaatgcttactaggctaggtcctggctatatggtgatgaaaaaaggagatctttttgtggcactgatggacttaagagcacagtgagggtaataaccaacaaacaaattaaaaaaaaaaaccctaaattacaaatgttgatgctaaaaagagaaagaacagagagtgtgagagtgtgtaatgatgtataggattacctagatcgagtgagtggttaaggtctcttagacccacagattgagattaaaaggaaccagagatgtgaattttgtgacctcagcaccacttatttaacctctttgagcctcaattttctcatctgcaatgtggaaataatcacaggactcctgtgaggatggatgacataatgaataaagtgtttagcctgtaaataaaaggcagccctaaataagtggtagccatacttaatgttaatgttagacatggtatggagaatgaactttaggggaaggactggaatgtaaacagtttagtaagggagctgttgcaatagccaatagggttgatgacagcagcctggattaggatggtgacagtagaggtggagataggttagagaggattttacatggaaggaagaattacctgggttttctgggtttttattgtctatgggaggaaatatagtggcaaaggtcagaattactccctaatttctagcttgagtgtctgggaggggagtcaggtcactgactgaaaagggaagcacagattcaggaatgaatcaccaatcccacatccctatgagacaggaaccaagaatatgtccagattggaggggagagaaattggcaacacaaagggagcaaactgcccacaagtaggcaacaatagagccagactcatagatagaggaagagaaagacacacacacacacacacacacacacacacagagagagagagagagagagagagagagagagggatggggtgagggaacagagagaaggaatatactctgattttagtccttccatccaggattttcttgttagtggcttcttagcttctcctttcttatatttcagaaatgacacaattgtccatagcaagctaagtgttccctctaagagagtctatgtttctgctcaaccccaaataaataccttctgcctctcctcatcacggggattttacatctaatggtcactaagaagatttgggggaaaaaaagcccttcttaccttcccttcagtctgaagcaaaaaagaggtttttggaaacaagccatgcaaatctctacgctcacaatgaactgtgaattgcagaagcataagaacccacatttaaaaaataaaaaaggtgtaaacttgacctctagcttgctgttctggcataattgggctctgttatttaacagggaggtgtgaacagaacatgcccattttgtaagtgaaactttctgcaccagtgaagctaaaacaaatagccatttcttttaagtgcaaaagtggaagtgtgactgcaggagagtaaggttatgaacaattcttagttattgaaattgtaatgcactgatggatctttctttgctctctcactgcctgtgtgtggacaatagttgatagtagaagcagtgccaacactaaaatcaaagtaggtggtagggtgggaacagtgtggcataagtagggacaggtgtttacttctattctgattgtccaactagacgaattctagtgttatataagttcctactatgggattagaatggttctgccacaatgtgctcttcacatgtcacagtgaaatcgaaataatgtcttttgtagcaacgtggatggagctggaggccattattctaagtgaagtaacacaggagtagaaaaccaaaaaccaggtattctcacttataagtgggagctaagctatgagcatgcaaaggcatgtggagtgatagttaagacagccaaattctactaagtagtctctcctagtcagggagaggaaagtggcatagtggaaataccacacgcttcagagcaagccaggaatgatagtaaatcctatctttaccattttctagctttgctacttaaggcaatttactgaatgcctctgaagctcagttttttcatctagatcatagggtgataatagttcttacatcttaggacagttgtgaaaattaaattaaataaatacacctgaaaacttccattacagattttgggatacatccttgatcgtcaccacatgataattatttcctgcctttccatttgtgagagtcccttccaccctccattctaagtaacacatacataagcaagatgactgcatgactgtttaagatgtatcacaaataagagggcaaatagggagatggaatagaatgggggaaagcaaaagttttatttacagtaacagcagctcataacagccacactcttttatctgtgaattcatcacttgaggctctgtttttgttagcacagctctatttcctggagcaggacttaatatgacaggaagccattctgctactcatgaggagaatctaaaaccaggttacttctttgctttttgtaaacttactttaaacaaaacaaaaaaaaaaacaataaacaacagaaacccttccccatctgagaaacaacctcagtacattgttttttttccacttctagctcgaaatacagtaaacattcctgcaatatgcacagaaggtatgcttgtgaactttgtcatggggagaaaaacaaagatgaggagaagggtgtgcatggaagcaaggtcccttgtcctcccatttcgagtctcagatcttccattaatagctgtgtggccataataaactcctctctctgggccttgcttctatctatattatgtggagagtgaatttgatgatttccaaaggtccttcccagtctgaaattctacaagatagttaaagcaaaatgaggaatctgttgctctcctaccattcttatctgcaggcaatcagcataattccatgcctagcctctgataatctctaaagattactctactctctctataccttaatataacacataataaaaaccatactaaatcataaaatatgattaaggaagtccaaaaaagaaggaatctcttcataatgattactttaatgaataaagaaagcattacattttaaactgtcttcaaaaatggtttcagtggccctgttttgctagtgcccaaagcattgctagtgcccacaagcattgctagtgcccaaagtattgtgactgttggataatatgccatgtgaatgttgccacaccaatacaggattctacttagaggtagaattggtcttttcccctccaagattatatgaaggaaaatactctattttagcttctaaattcatgtattattaaagctttttatgtaaatttggatacccaagcctagggagagagacaaactgcaggataacctagagtcacaagttattatgatagaataatgaggccacattctcaggtcttgaagatcagccgggacactgacaatgcaggcttaaggaggcaggacaatttttcaagtgatggggttccaagataagaagccaggacccaaagagcaaaatggcagacaaaggacagggatgggaacctaaaaagtgaggctaaatttctactactgcaattaggagtgagcagtatttattctaaccagggctttggacaagacaaatttggagtcaaaataaatataatcgaattctatgctgtttttgctgtggtcagaataaaagatttaacatttcaagacatcttagcctgcaaaatacaacttagagaatctggggtggagggtgcagttgtgggacaattttatggttccttaactgttacattgggtgactttggatcagtactatattttccttgagcctctaattctttatatgtaaacatgtctcttctaattctaatagtctgtgcctctgtaagtataaaagagagatctaggtgttaactaaagaactaattaaccattttactctttattttgttttactttgggcaggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaaaattaagatatctctttaattacgcctttgtttacctacgttccttgtctttttccaaaggccagaattgtcaaccaatttctttaattgaacattgtaaaaaacaggaataagtacttttgtgtaatattcacagtcaacaggggtgtgatggtgaaggcagagtgtgaaaaacgtgagagaggaagagaaaatagatttacctgattcctctttaaaattcaagccactttcttatttaagaaacctagatcaagtttttacagatgtaaataaaagttgaatagtttaccttaaatttttttcaataagtaagttattgttaataatgcacagtaaatatgtgaatttttcctagatgtaaaaaaaaaaatctttcatataaagaccttaaattctgagtgagagtaaaaa

SEQ ID NO: 5751 - DNA, 88241 bp, human
aatagcaccgcgagatctgttgaaacattgatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagctgtatgttgaaaacccatgttctcaaagccttgcgcattttaagattcctattacgtagtgatttttctgatcttagctcgttgtaggaattaggcactaaagtactgagcaatgctgcagagttttgaaggaaagtttcaggtttccttaagcccagaaatggcaggattggttttctttttgaattttgtgttttgttaaattagggaaccctgcttccgtgggaatttgcaggaggcctgattggcaagtttaagaatgaaggaataaattacaaagaaaagattgaaaatattgtgtaaaaagatggatgatttttgttttgttttgctttttaactgactgaagtaagggatttgggagaacatattgcagatgttgaaatggtgaagagagagatcagatggttatttgtagctctaaggaaatgagcaaacagttaataatgtccagagacagaccatatacttcaaagtgtagttttaggttcccagattatgttaaatgaacagaaaaaaaggaatttgcaagatgaatgagagtggagaggagtcagtcgcttgtcctacttcttttcctttgctgtttttccactgtctccagtctagtggtttactgtctttgcctaggctcagtgcttacaatagctttgttaactgttccctacccacaggttttcccttctccaatctgtcttaaatactaattccaaattaatctctttacatgttgtccttaaaacaacctcaagaggtgggtactattacattaattttacagatgaagaaactgaaactcagaaaaatagttttcctaaaatcatatggttagtacattccagagttaggaactccagaggccaccttcttatttttttttaattatactttaaattctagggtacatgtgcacaacgtgcaggtttgttacataggtatacatgtgccatgttggtttgctgcacccatcaactcgttgtttacattaggtatttcacctaatgctatcactcctccagccccccaccccccgactggccccggggtgtgatgttccctgtcctgtgtccatgtgttctcattgttcaactcccacatatgagtgagaacatgtggtgtttggttttctgtccttgtgatagtttgcttagaatgatggtttccagcttcatccatgtccctgcaaaggacatgaactcatccttttctatggctgcatagtattccatggtgtacatgtgccacattttcttaatccagtctatcactgggacatttgagttggttccaagtctttgctattatgaatagtgctgcaataaacatacatgtgcatgtgtctttattatagaaagatttataatcctttgggtatatgctcagtaatgagattgctgggtcaaatgacatttctagtctagatccttgggggatcgccacactgtcttccacaatggttgaactaatttacactcccaccaacagtataaaagcattcctatttctccaaaccctctccagcatctgttgtatgattgccattctaactagcatgagatggtatttcattgtggttttgatttgcatttctctcatgaccagtgatgatgagcatttttgcatatgtctgttggctgcataaatgtcttcttttgagaaatgtctgttcatatcctttgcccacattttgatggggttgtttttttcttgtaaatttgtttaagttcttcgtagattctggatattagccctttgtcagatgagtagattgcaaaaattttctcccattctgtaggttgcctgttcactctgatgatagtttcttttgctgtgcagaagctctttagtttaactagatcccatttgtctattttggcttttgttgccattgctttcagtgttttagtcatgaatctttgcccatgcctatgtcctgaatggcattgcctaggtcttcttctagggtttttatggtgttaggtcttacatttaaatctttaatccatcttgagtcaatttttgtatacggtgtaaggaaaggatccagtttcagctttctacatatggctagccagttttcccagcaccgtttattaaatagggaatcctttccccattgcttgtttttgtcaggtttgtcaaaggtcagatggttgtgatgtgtggtgttatttctgagacctctgttctgttccattggtctatatatctgttttggtaccactaccatgctgttttggttactgtagccttgtagtatagtttgaagtcaggtagcatgatgcctccagctttgttctttttgcttaggattgtcttggccatgtgggctcttttttggttccatatgaactttaaagtagttttttccaattctgtgaagaaagtcattggtagcttgatggggatagcattgaatctataagttactttggacagtatggccattttcacgatattgattcttcctatccatgagcacggaatgttcttccatttgtttgtgtcctcttttatttcattgagcagtggtttgtagttctccttgaagaggtccttcacatcccttgtaagttggattcctgggtattttattctatttgtagcaattgtgaatgggagttcactcatgatttggctctctgtttgtctgttattggtgtataggaatgcttgtgatctttgcacattgattttgtaccctgagactttgctgaagttgcttatcagcttaaggagattttgggctgaaacaatgggattttctaagtatacaatcatgtcatgtgcaaacagggacaatttgacttcctcttttcctaattgaatacccattctttctttctcttgcctgattgccctagccagaacttccaacactatgttaaataggattggtgagagagggcatccttgtcttgtgccagttttcaaagggaatgcttccagtttttgtccattcagtattatattggctgtgggtttgtcataaatagctctcattattttgagatatgttccatcaatacctagtttattgagagtttttagcatgaagggctgttaaattttttcgaaggccttttctgcatctattgagataatcgtgtggtttttgtcattagttctgtttatgtgatggattacattaattgatttgcatatattgaactagccttgcatcccagggatgaagccaacttgatcgtggtggataagctttttgatgtactgctagattctgtttgccagtattttactgaggattttcacatcgatgttcatcagagatattggcctaaaattctccttttttgttgttgtgtctctgccaggctttggtatcaggatgctgctagcctccagaggccaccttcttaactattactgttaactcactgcctggaagagtgaaagtactaaaaaaaaagttagcaattttttcatcctaaaacaccactttcttatattactgaagacaacgtaggcagaaatacttaaattagctctccattgactatcgaactaaacctaaattatgttgctaaacagttttcaccataatctaggcccacactattcatacaatcttacttagtgctcccccaaactaacttccctatgtacgtaatcattgttgactacctgctgcaatcatcatgcttatgatcactctcatgcctttgctcttcctgtttctttcttcaccttctccccacattctcataaccttttctgccctctccacttatccaactcttgcctttgctagacacaactcaaaatctttatacaaataatcaggcaaaagtaagtcagcatgatctagtcaccctcctcattgccaacatcagggctactgctattgcacttttcggcctatgcaacaggagactctttcttctgttttttttttttcattttgcaaaatgaacataatttgtcttatactaccgtagtatgacatccctttcccttctcaagtggacactgctatgctctcacccctcactcagaactaagagtctccaggtgagttattttcatttgccacaccaaaagtagctgaattttcttgatcagcaaataccccctcagcagaagcactctttatcatcactgagctctttggagttgtaattcaccctcttttctcgccctgataattcctcactttcctcttgaggtctttgatatttttcatgtattataaaataccttccaatattttaaattccctttatcaagagagttccagatcacctatccccaccttttccagaagcagaaattttacctacttttaaacttttgagaaagttaaaatattatttacctacaaaacactacaaaattatggtgtagaaatgtttaatgaactgtctgaaaaacattatcatgtcaacttcattgaatattaagtttactatttgtaaaaatttcatttcatttgaaaacaatttggagtttacatttttatctcacataagcagaattcctgtttctgcagagaaatcactgtcgagcatattttaatgaattgcttgtggctgaaaattttttaaattttaaaacaaagttatacaaattttagaatatgcttaatatttatatttaagtgggattataagtacatttgcatttttatgtttgatacactgtgaagtggtgtgtattagtctgtttcacactgctataaagaaataccaaagactgggtaatttataaaggaaagaggtttaattgactcacagttctgcatagctggggaggcctcaggagacttacaatcatggtggaaggcaaaggggaagcaagcttggaccttctcacatggcagcaggagacagaagagggaggagcaacgggggaagagctccttataaaaccatgagatcagctgggcacagtggctcacgcctgtaatcccagcactttgggaggctgagatgggcagatcatgaggtcaggagattgagaccatcttggccaacaaggtgaaaccccatctctactaaaaatacaaaaattagccaggcgtggtggtggccgcctgtaatcccagctacccaggaggctgaggtgggagaattgcagggagaggttgcagtgagccgagatcacgccactgaactccagcctggcgacagagctaaactcctcaaaaaacaaaacaaaacaaaaacaaaaaacaaacaaacaaaaaaaacccatgagatctcatgagaactcattcactatcactagaccagcatgggggaaaccacccccatgatccagtcacctcccacctggtctctctctagacatgtggggattatgaggattacaattcaagatgaaatttggatggggacacaaagcgtaaccaaatcttcccgtttccaaagtaagaatgtctggagtcttggtggtcttcaaagagccttgatttttagaagaaccaacaacatcactcaatgatgccctagtgcccaccttcctgcctcctctggcagatgggagaccagtaatataaaattttttctctattaacacacaacacattaacacataaatatgtaaatcacatacaaaattaccgcacattggaggatatactgttgttctcttcaagtgccagcagaaggggagtatctgcagaggagatagggtaggttaagtaacagagtgttatgcttaagaattcttatcctgtctcagtcacctgctatgtagtgatgtgcatcagcaggaagcaacattgactccttaccagagggagtcctgaagtattgtgttcagaggtctgatctcatcccagatggtacgttcatgattagagccactagagggcgccactcagctatagaaaaacaatgtggaaggctttgaagcgccggacttaagagatgtaatttttattagctctttacagaattccagcagagggatagaatgtcatttcatgcgttgtccctgagcagtaacagtaaatggtctcaaggaaaaataaggctctactcaggagcatcccctatttccaaaaccttctgatagtttgagtaagggttactgccccactcttccgttgggtatcactgactccagaggaggagcgaataaatttggttatcattggaaagagacaggatagggatagggtggaattttaaaccccttaaaacctcagaagtcactctaaccctctgtgatggttaatactgagtgtcaacttgaatggattgaggatgcaaagtattgttcctgggtgtgtctgtgagggtgttgccaaaggagattaacatatgagtcagtggactgggagatgcttacccaccctcagtctggctgggtaccatctaatcagcttccagcactgctagcataaaagcaggcaaaggaacatggaaggactagactggcttagtctcccagcccacatctttctcccgtactagatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtgtgagtcaatgcttcttaataaattcccctttatatatacacctatcttattagttctgtccctctagaaaaccctgactaatacgctctctatcttccccccacatcctaccagtaataactccatagagtggttgtccagaaattacttatgaacacctccagttacagtgagctgaaaattccagaggcatttccattctgcttttagtcagcttaaaacattagaacattattttctgagattaagctgagaactgtttcctttcatgtttctttgattctaataattacccattataaactcatctttatccttgtaatatgaagccttctcttctccaacttagtatttcctgtttctctagccattcttcataagctgtgatctctagaggtgtcactaaatatgtttcagtttgtcagtttctctcttctacaaaaggtcgtcccagaattgaatgtcataatccaagaatggtatgactagcattgtataaagtagtgtaaggtcctcattctggacactttgtttctcttttagcccttttattttctgaggaatagtatttcacagtggttttaatttacatttcactgattactaagaagttgtgcatcttttcatatatttattgccatttatatattttcttttgtggaatatctgttaagaactttttctatttttctatatttttttgtctctattcctaatagcaacattttgtccctatgtgttgcaagtaacttttatcctgaggctagcctttttttaaacatttttaattagtcatatataaaatatttttctttatggttaatgcttttctgtgaatttttaaagaaatctttccagaccctgagaacgtgaaaatgttatcttacatttatttataaaagctttattgtggtgctttttacatttagatctacattccacctggaattgatttgtgtgtaaggtttgagatatatgtcaagtttaatttttttcaaatagctatccaattattctagcaccaataattgaaactacacccttttcccactattttgcaataccatctttgtcaaaaatcaaatgattatacatgcgtgagtctgtttctggtgtctgtattctgtttcatttgtctatttgtctacccttgtgccattaccacactatattacttattataaatttaaatatcttgaaatgtaatatggcaaattctcctactttggtcttcttcatgaagtgtcctgactattcattgccctttatatttccttttaaaaaggtagaatgtttataaccgcaatatacaaatacaattgattatagtatgttgaccttgtatcaagtaattttctaaactcatatgtgaatattaatagtttatctgtatattcttttacattttctatttacacaataacatcaaccataaaaaatggcagctctattttttcttccaatcttatactttttattcattttcatttccttatttcctttgacacctccagaacactcattcctttcaccattgttgtgtaacaaacaaccctaaagcttagtggcatgaagcaaccattttattatactcacagattctgcaggtcaagaattcagccagggcacagaggtgactacttgtctcttctctactgtaattaggacgtcagctggaaagccttgaaggctgggagtcacttgatggctgcaggctaaaaccatttggaggtttctttatttgtgtttctggtgcctttgttgaaatgattcaaacattaagctcagatgtaaatgttgactagagtgcctgaatatggcttcaccacatgactttctcatggcatggcagcttcagagagttgatcttctcatactgcagcttacagcccaatgaacaaggcagaaactagatcatcttttatgaccttatcttggaagtcacatagcatcatttctccgaacagctataatccagaaacaagaaaaacaacacttgaatggactccaaaggaacctttaaggtgacttggataggctccaaaagcaaaagttatatgtctttgaaaaaagatagcatcatctggagcctcattgttagtaccacattttcatctcaaagtctagcactcgattgaaaataatcttacctaaaaaaatagatgtgactgaaaactaaagactagaaaagcacacaaaaattaaaaagaggtattaccatcaaaggagtagcaaaaaaaaaaattattgctgactgtacatcagaacaaatgagaggcagaagacaatgaaaacatggcttcaatgttctaaaagaatataactgtcagcatagaatataactgtgctaaaataataactgtcagcatagaaatctaaagccaacaaaaatatcccttacaaactaatgtgaaataaagacactttcatataaacaaaagagaattattcaccaaagttttacactaattgaaatactaaagaatgtatttcgggtaaaataaaaaagattatagctaagagatgcagcaagaagtgaagaacaacagaaatggcaaatatctgagtaaatctgaatgagcaatgtgtaaaacaataataacaaatgtcttgtgagtttaaaatatgtacagaactaaaagacataagaaaaatttaaaattgtatatataaataaaaaccttcccacaaagtaaactataggcccaggttgtttcattggcaaaatttaccaaacatttaaagaataaataatgccaattttacccatattcttcaatataatagaagaaaaaggatatttctcaatcatttcaagggcagcttagtgttcattccaaagcttgatgagtacatttcaagaaaagaaatacacaggccaatctcatctcttgaaaaatagaagcaaagttactaaactaagtagtatcaaaccaaatccagtagtatataaaaaggatagtactttatgaccaagttgggttattctaattgttaagcagaacactgggcatcacttgctaatcccaggaattgactctaatcacatatgcccattgcatcgctttatcagagtcatgaaggagaacataatgcagtcaagccctggatgaaacaacactttacttatatagaaaaaaaacagagcacaatcagcttcaatagtgtgtgttggtaccctccatggctagacggtaccccctagcaacaaacacagagcaactggataagcacacccttcttgtgccttagaaaaaggacccttatccacacccacaccaacccagtctgaaagacagaaagctaggacatgtctgagagccatggatgcatacacttagtaaaacaaaagaacacttagtaagtctgaaacagaaaaatatttctagcctggaacagggtgtgtaggctgcttatctcttgctaaggaaatattttagtcccaatgcctattttaaatggccatgtgggggtcaaaagactgcatacacaagattgcctttcccaacactaagaattcagggttggttcaacacttgaaaagcaatcaatgtaatgtgcctcattaacttaagaaagaagaaaaatcacatgatcatctcaatagatgaagaaaagtaatgtgataaattcagcttcccttcatgattgaaaattagcaaactagaaataaaaagagcctctttaatctgataaaagatgtatataaaaagctaaagcaaacagtatacttagtggtgaaatattaaacttcttcctgtgacaatgggaatgaaacatgaatacctgctattacctcttctactcaacatagtgctagatattctaggcaatataaaagaagaaaaataaaataaagttataatttttggaagggaataaatttaaatgtaaccaattgtaaataatacacatgtatgtagaaaatacaaaagaaaatctaataaactattttaaataataaattgtttgagcaagataactgcctgcaagatcaatatgtaaatagaatggtatttgaacatattagtaacagacatgggaaataaaaatgtttaaacataccatttaagataaataaaacaatattgaaggaaaagaacagagttggaggactgacactacccaatttcaaggcatactataaagctacagaaatcaagacagtgtggtattggtgaaagaacaaatagatcaagggaatagactagagagcctagaaatagacctacattaatacagtcaactgacctttaataatgaaggcaattgagctaataaggtagttcttttaacaaatggtgctggaataactggatacctgcatgtaaaaaaaaatgagtctagacatgagattttacacccgttacaataattaactcaaaatggatcactgacctaaatttaaaatgcaaaactataaaactcctagaagataccataggagaaaatctaggtgactcagagtttaacaatgacattttagataaaacaccaaaaccacagtccataaaagaaataatccgtaaccttaacatcattaaaattaacaaatttcttacagagaatatgaaaatttatttagatagagagtagattggtagttgctagaggctggtggtgagggtttgggaagaatagaggggttgggaggtgagaactaaagggtatggggtttatttatggggtcgtgagaatgtcctaaaattggttgtggtgatgattacataactgaatatagtgcagataaaaactattagattgtaccctttaaaggaataaattgtataatatatgaattatactttaataaatctgttaccaaataaaatttaaaagttcagctctgcagaagacactgtcaagagaataaaaagagaagccagagactgggagaaaatgtttacaaaagacatatccgataagggacagttttacaaaatatacaaataacaaaatatacaaaatatacgaatacttaaaactcaacaataagaaaatatacaaatacttaaaactcaacaataagaaaacaaacaaccaaataaaaatgggccaaagatcttaagcaacacctacctcattaaagaagttatacagctggcaaatatacatttgaaaagatgctcagcttcgtatgtcatgatggaaatgtaaatgaaaacaacaatgagataccactacacaactattagaataaccaaaatccagaacactgacaacagcaaatgctggtgagaatgtatagcaacaggaacatcattcattgctggtggaaatgcaaaatggcccagccactttggaagtcagtttggtggtttcttacaaaatgaagcatactcataccatattacccagcaatcatgctgcttggtgtttctccaaaggagttaaaaacttatgtctacagaaacaagcacatggatgtttatagcagctttattcacaattgcctacacttggaagcaaataagatgtccttcagtacatgaatgaatagattaactgtggtacatccaaaaatgaaatattattagatactgaaaagaagtgagctattaagccatgaaaatacatagaggaaacttaaatccttactattaagtgaaataagctagtctgaaaaggctacataccgtatgattccaactatgggacattatggaaaaggcaaaactatggatacagtaaaaacatcagtggcttccaggggctgggggtaggtagagacaaataggtagagctatttgaaaatattctatttgaaaacacacagccagaggagacaaaataaaaaacaataaaaaacaagtacacctacaggatctagaaaatagcatcaaaggggaaaatcttaacacagttattggctttcaagaataggtagagaaagagagactctcgggcagcagactttttggtggaaaccttacagtccagcagtgctggaagaagaaaacttttactctagaatagtatattcagcaaaaatatccttgaaacataaaagagaaataaagactttcccagacaaacaaaagctgagagatttcattaacaccagacctgtcccacaagaaatgctaaaaggaggacttcagtcagaaataaaagaacattaataagccatgagaaatcatctgaaatacaaagtaaactggtaataatgagtacacaggaaaaaaaattgtagcactgtgactgtggtgtgtaaactactcttaccttaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcagggacaaaaaaccaaacaccgcatattctcactcataggcgggaattgaacaatgagaacacttggacacaggaaggggaacatcacacatcagggcctgtcgtggggtggggagaggggggagggatagcgttaggagatataactaatgtaaatgacgagttaatgggagcagcaaacgaacatggcacatgtatacgtatgtaacaaacctgcacgttgtgcacgtgtaccctaaaacttaaagtatatatatataaaaaaagtagaaagactaaatgatgaaccagtcaaaaacaataattacaacatttggctgggcacaatggctcacgcttgtaatcccagcaatttgggaggccaaggctggtggatcttttgagcttaggagttcgagaccagcctgggcagtgtagcaaaaccccatcagtacaataacaataataataataataataataataataataataataatattctgtgcacagtggcacatgcctgtagtcccagctactcaggaggctgaggtgggaggattgcttgagcccaggaggcagagattgcagtgagccatgattttgccactgcactccagcctgggtgacagagtgagactctgtctcaaaaaaggaaaaataaacaataattacaacttttcaagacatagacagtacaataagatataagtagaaacaacaaaaagttaaaaaaaaggaatgaagttaatatgtatggtttttaataattttctttttgcttgcttgttaggttttttattcaaacagtgtaaagtttctaactaaaaataatgggttataagatagtaacctcttgtaaggttgtaagcctcatggtaacctcaaatcaaaaagcatacaatagatacacaaaaaagcaagaaattaaatcatacaatcaaagaaaatcacctttaataaaagaaagacaggaaggaaggaaagaagaaagaggaaacacaaatcagccagaaaacaaataataaaatggcaggagtaaatctttacaatcaacaataacactgaccagaaatgaactaaatgctcaagtgaaaacacatagactggctgaatggatttaaaaaatacccaattatctgttgcctgcaagaaacacacttcccctacaaaggtgcacatggatcgaaaacaaaaagatataaaaatatattccataccaatggaaacaaaaaaagaggaagagtagctacactaatatcagacaaaataaatttcaagaaaaaaattctataagaaggaacaaagaaagacactctataatgatgaaagtgtcaatacagtcagaaaatatgacaatttttaatgtaaatgcacccaacactggaatacccagatatataaaacaaatattattagagctaaagagagacagatgccccaatacaataatagctggagacatcaaacacccgactttcagcattggacagctcttccagaaagaaaatcaacaaagcaacattagaaataatctccactatagaccaaagtgaactaacagaaatttacagaacatttcatccagtggctgcagaatacacattcttctcagcacatggatcattctcaaggatagaccatatgtacagtcacaaaacaagtctttaaaaatttttaaaaatattgaaataatatcaagcatcttctctaaccacatggaataaaactataaatcaatgacaagagaaatttaggaaattataaaaacacatggaaattaaacaatatgctcctgaatgaccggtggatcagtaaagaaattaggaagggaatataaaaattggttgaaacaaacgataatgtaaacacaacataccgaaatctatgagatacggcaaaagcactactaagatggaagtgtatagctgtaagtgctacataaaaaaatacttcaaataagcaacctaataatttattgtaaagatgtgcttattttacattgcatgcctatatcaaaacatctcatgtaccccataaatatatacacctactatgtacccaaaaaattaaaaattaaaaaattaaaattaaagtcaaagaactagaaaagcaagagcaaacaaaacacaaaattattcaaagaaatgatatcagagctgaaattaataaatatgaaatgaacaaaataatacaaaagatcaatgaaacagaaagttggtgttctgaaaagataaattaacaaacctttagtcaaactaattctgaaaaagagagaagacccaaataaaatcaatgttgaaatatgtgacatttcaattgatactgaagaatttcaaaggatcattagtggctactgtaagcaaccatatgccaattggaaaatctagaagaaatggatgaattcctacacaaatacaagttaccaaggttgaaccatggataaatccaaaacctggacagatcagtaacaactaatgagattgaagccgtaatagaaagatttttagtaaagaaaagcctggcacccaatggtttcactgctgaattccaccaaacatataaagaagaattaataccaacctactcacactattgtgaaacatagaagaagaggggacacttttaaattcattctatgaggccagtattgctctgatacaaaaaaacaaagacacatcaaaaaaggagaactataggtgaatatctttgttgaatattgacacaaaaatactcaacaaaatacttccaaactgaattcaatcacacattaaaaatatcattcatgatcaccaagtaggatttatcccattaattgaaggatagttcaagatatgcaaatcaattattgttatacatcatataaagagaatgaaagactaaaatcatatgattatttcaattgatgctaaaaaagcatttgaaaaaaatccaacatcccttcatgataaaaaccctaaaaaaactgggaatagaagcaacatacctttacatagtaaaagccatgtatgacagacccatagttagtatcatacttaatgaggaaaaactgaaagtcatttctctaagatcaagagcatgacaagggtgccaacttttgccattgatattcagcatagtactggaagtcctagttagagtaatcagaaaagaggaacaaataaagggtacccaaattggaaaagaaaaataaaattatccttgtttgcagatgatgtaatcttatatttgataaaacctaaaatctcctccaaagagctattagaactaatatacaaattcagtaaagttgcaggatacaaaatcaacatataataactgctagcatttccatatggcaacagaaaacaatctgaaaaataagtcaagaaagtaaccccatttgcagtagctacaaataaaataaaataactgggaattaacttaatcaaagaagtgaatgatctctacaataaaaactataaaacattgatgtaagaaattgaagaaaagaaaaaattggaaaggtattccacaatcatgaatgggaagaattaatattgttaaaatattcatagcacccaagcaatctacaaattcaatgtaatatctgtcaatgtaacaatgacattcttaacagaacaaaaatctaaaaatttgtatggaaccacagtaaacccagaatagccaaagctattctaagaaaaagaacagaactggaggaatcacatacctgacttcaaattatattacggagctatagtaactaaaacagcatggtaacaccataaaaacagacacacagaccaatggagcagaatagagaaaccagaaacaaattcacacacctaaagtgaactcattttcagcaaaggtgccaaaaacatacactggggaaaagaaagtcactttaataaatggtgttgagaaaactggatactcattctcaaaagaatggaactaggtcccgctctcttgccacatagaaaaatcaattcaaaatggattaaagacttcacctaaggtataaaactaagaaactactgaaagaaaacattggggaaactctccaggacattggactaggcaaagatctctttgagtaataacccacaagcataggaaaccatagcaaaagttgacagatgatatcaaatcaagttaaaaagcttctgcacagcaaaaaacaaaaacaaagacaaaacaaagcaaaacaaaaaaaaaaaatcaataaaatgaagagacaacccacccagtgggagaaaatatttgtaaactacccacctgcattactcagttctaacactgctataaagaaatatgtgagacggggtaatttgttttaaaagaggtttaattggctcacagttctgaaggccatacaggaagcatgattctggcatctgctcagtttctgggaaggtctcaggaaactttcaattattgagaaaggcaaaagggaagcaagcatgtcttacttggccagagcaggagcaagggggcagaaggtactatacacttttaaacaaccagttctcacaataattactattgtgatgacagctccaggagggatggtattaaaccatgagaaactgcccccataatccagtcatctcccatcaggccccttctccaacattggctattacaattgaatatgaaacttgggtgaagacaaagatccaaaccatatcattccaccccggcccctcccaaaactcatttctttctcaaactgcaaaatacaatcaggccttcccaacaggccctcacagtcttaactcattccagcattaactcaaaagtccaaatttcaaagtctcatttgagacaaggcaagtcctttccacctaagagcctgtaaaataaaaaacaagttagttacttccaagatacaacagcaatataggcatttaataagcactcctgtttcaaaagggagaaatcatccaaaataagggactacaggccccacacaagtctgaaacccagaaagaaatttattacatcttaaatctccaaaataatctttgacaccaatgtctcacatccagggcacactggtgcaacactgctccaacccctcatttcccctccatgctgccctagcagaggttctccatgagggctccacccctgcagcagcttctgcctgggcatccaagcttttccatacatcttctggaatccagatgtaggctcccaagcctcaactgttgtactctgcacacccacaggcttaatacaacatggaagccaccatggcttatggctttcaccctctgaggcagtgacccaagctgcatctgggccccttttaagccatagctgggattggagcagctgggatacagaaagcagtctcctgaggctgcacagggcagcggggccctgggtctggctcaggaaatgattcttccctcctaggcctccaggcctgtgatggaaggagctgccaagcaagtctctgaaatgctttcaaggcattttttttttcattgtcttggctatcagcacttgcttttctcttagttatgcaaatttatgcagccagcttgaattcctcctctgaaaatggccttttcttttttaccacatgaccaggctgcaaattttccaaacttttatgctttgcttcccttttaaatataagttccagtttcagttcatttctttgctgcttagaaatttcttccatcagataccctaaatcatctcataacagaagtgaccaatacgtttcttatcttcatctgagacctcctgagactggccttcactgtccatatcactatcagcattttggtcataaccattcaaccagtctctaggaagttacatactttccctcatcttcctgtcttcttctgagccttccacactcttccaacctctgcccattacccagttcccattacccagttccacttctacaatttcaggtatctttatagcaatgccacactccttgataccaatttgtcatattagccaattcacacactgctataaagaatacctgagactggataatttataaagcaatgaggtttaattggcttattaatggataaagaaattgtggtacatatacacaggcaggcatacaggaagcatagcagcatctacttctgggaaggcctcagggagcttttactcatggcagaaggcaaatcagaaacaggtgtcttacatggcaggagcaagaccaaggaagcttggggtggggggtgccacacacttttaaacaaccagatatcacaagaattcattatcacaacaacagctccaatggggacggagttaaaccatgagaaatcaccccatgaccaattcacctgccaccaggccccacttccaacattgggaattacaattgaacatgagatttgggtggggacacagaaccaaaccatgtcaccatctgacaaggaatttataaccagaatatataaggagctcaaacagttctgtaggaaaatgcctaataatccaattcaaaaatagacaaaagatttgaatagagatttctcaaatgaagacataaaaatgataaacagatatatgaaaagacactcaacatcattgctcatcagagaaatgcgtatcaaaaccgcaatgatatatcatctcaccccagttaaaatggcttttatccaaagaccggcaataacagatgctggcaaggatgtggagaaacgggaacccacatacactgttggtagtaatgtaagtgagtacaaccactataaagaacagtttggaagttcctcaaaaaactaaaaatagagctaccatatgatccagcaatcccactcctaggtatatagccaaaaagaaaggaaatcagtatatcgaagagatatctgtactctcatgtttattacagccctattcccaatagccaagatttggaagcaacctaagggtctgtcaacaaatgaatgaagatattgtagtacatatacacaactgactactattcagtcataaaaaagaatgagatcctttcctttgcaacaacatagatggcactgtaggtcattatattaaataaaataagccaggcacagaaagacaaacatcacacattctcacttatttgtgggtgttaaaaattaaaacaattgaactcatgaagataaaaactagaatgatggttaccagatgctgggaagggtagtggctagacagagagaagttgggatggttaatgggttcaaaaaacagaaagaatgaataagacctagtatttgctagcacaacagtgtgactatggtaaaaaataattatacctttttcaaaaactgaaagagtataattggatagcttgtaaccaaaggataaatacttgaggtgatggataccccatttacaccaatatgattattatgcattgcatgtctgtatcaaaatatatcacgtaaccgataaatatatgcacatactatgtacccacacaaataaaaaataaataaaaaaccaaaaaatttaaaaataatttaaattttaattaataatgaataaggtttggtgttaaagatgtgtgaagggatatataaattgtctctttttaatgtttttttattatactgtaacttctagggtacatgtgcacaatgtgcaggtttgatacataggtatacatgtgccatgttggtttgctgcacccatcaactcgttgtttacattagatatatctcctaatgctatccctcccccaggccccacccctgacaggcccctgtgtgtgatgttccccgccctgtgtccaactgatcacagtggtcaattcccacctacgactgagaatatacagtgtttggttttctgtccttgtgatagtttgctgagaatgatggtctccagcttcatccatgtccctacaaaggacatgaactcatcctttttatggctgcatagtattccatggtgtacatgtgccacattttcttaatccagtctatcattgatggacattagggttagttccaagtctttactattgtgaatagtgctgcaataaacatacgtgtgcatgtgtctttatagtagcatagtttgtgatcctttgggtatatatccagtaataggattgctgggtcaaatgatatttctagttctagatccttgagggatcaccacactgtcttccacaatggttgaactaatttacactcccaacaacagtgtaaaagtgttcctatttctccatatcctctccagcatccgttgtttcctgactttttaatgattgtcattctaactggcacaagatggtatctcactgtggttttgatttgcatttctctgacggccagtgatgatgagcattttttctggtgtctgttgactgcataaatgtcttcttttgagaagtgcctgttcatatcctttgcccactttttgatggagttgtttttttcttgtaaatttgtttgagttctttgtagattctggatattaggccttcatcagatgggtagattgcaaaaattttctcccattctgtaggttgcctgttcactctgatggtagtttcttttgctgtgcaaaagctctttagtttaattagatcccgtttgtcaattttggcttttgttgccattgcttttggtgttttagacatgaagcccttgcccatgcctgtgtcctgaatggtaatgcctaggttttcttctagggtttttatggttttaggtctaacatttaagtctttaatccatcttgaattaatttttgtataaggtgtaaggaagagatccagtttcagctttctacatatggctagccagttttcccagcaccatttattaaatagggaatcctttccccatttcttgtttttgtcaggtttgtcaaagatcagatggttgtagatgtgtggtgctatttctgaggcctctattctgtttcattggtgtatatatctgctttggtgccagtactatgctgttttggttactgtagccttgtagtatagtttgaagtcaggtagcatgatgcctccagcttttttctttttgcttaggattgtctgggcaatgcgtgctcttttttggttccacatgaactttaaagtagttttttccaattctgtgaagaaagtcattggtatcttgatggggatggcattgaatctataaattatcttgggcagtatggccactttcacgatattaattcctcctatccatgagcatggaatgtttttccatttgtttgtgtcctcttttatttcattgagcagtggtttgtagttctccttgaagaggtccttcacatcccttgtaagttggattcctaggtattttattctctttttagcaattgtgaatgggagttcactcatgatttggctctctgtttgtctgttattggtgtataagaatgcttgtgatttttgcactttgattttgtatcctgagactttgctgaagttgcttatcagcttaaggagatttggggctgaaacgatggggttttccaaatatacaatcatgtcatgtgcaaacagggacaatttgacttcctcttttcctaatcgaatacactttatttctttctcttgcctgattgccctgtccagaacttccaacactatgttgaataggagtggtgagagagggcatccttgtcttgtgccggttttcaaagggaatgtttccagtttttgtccattcagtattatattggctgtgggtttgtcataaatagctcttattattttgagatacgtcccatcaataccctgtttattgagagtttttagcatgaagagctgttgaattttgtcgaaggccttttctgcatctattgaaataaccatgtggtttttgtcattggttctgtttatgtgattgattatgcttattgatttgtgtattttgaaccagccttgcatcccagggatgaagcagtcctgattgtggtggataagctttttgatgtgctactggattcagtttgccagtattttcttgaggattttctcatctatattcattagggatgttggtctaaaattccctttttttgttgtgtctttaccaggctttggtatcaagatgatgttggcctcacaaaatgagttagcaaggattccctctttttctattgattggaatagtttcagaaggaatggtaccagctcctctttgtacctctggtagaattcggctgtgaatccatctgttcctggactttttatggttgtaattattgcctcaatttcagagcctgtttttggtctattcagagattcaaattcttcctggtttagtcttggaagggtgtatgtgtccaggaacttatccatttgttgtagattttctagtttatttgcgtagagatgtctatagtattctctgagggtaatttgtatttctgtgggatcggtggtgatatcccctttatccttttttattgcatctatttgattcttctctcttttcttctttattagtcttgctaactatcaattttgttgatcttttcaaaaaaccagctcatggattcattgattttttaagggttttttgtgtctctatctctttccattctgctctgatcttagttatttcttgccttctgctagcttttgaatgtgtttgctcttgtttctctagttctttcagttgtgatgttagggtgtcgatttgagatctttcctgctttctcttatgggcatttagtgctataaattttcctctacacactgctttaaaagtgtcccagagattctggtatgttgtgtgtttgttctcattggtttcaaagaacatctttatttctgccttcatttcattacatacccagtagtcactcaggagcaagttgttcggtttccatgaagctgtgcagttttcagtgagtttcttaatcgtgagttctaatttgcttgcactgtggtctgagagacagtttgttgtgatttctgttcttttacatttgctgaggagtgtttttcttccaattatgtggtcaattttggaataagtgtgatgtggtgctgagaaaaatgtatattatgttgatttggggtggagagttctgtagatgtctattaggtctgcttggtgcagagctgagttcaagccctggatatccttgttaaccttctttctcattgatctgtctagtactgccactggggtgttaaagtctcccattattattgtgtgtgagtctaagtctctttgtaggtctctaaggacttgctttatgaatctgggtgctcctgtattgggtacatatatatttaggatagttagctcttcttgttgaattaatcccttcaccatcatgtaatggccttctttatctcttttgatctttgttggttcaaaatctgttttaacagagactaggattgcaaccacttctttttttttttttttttttttttttttttttgctttccatttgcttggtagatcttcctccatccctttattttgagcctggtggtgacaaaatctcttggcatttgcttgtctgtaaaggattttatttctccttcacttatgaagcttagtttggctgaatatgaaattctgggttgaaatttttttttaatattttagtacatttattaaattagtaaatgtaatcttagaacatgtattagttctttaagaatgttgaatattggcctccagtctcttctggcttgtagggtttcttctgagagatccgctgttagtctgatgggcttccctttgtgggtaactcgaccttcctccctggctacccttatcattttttcctttatttcagccttggtgaatctgacaattatgtgtcttgctcttactcttctcgaggagtatctttgtggtgttctctgtatttcctgaagttgaatgttggcctgtctttctaggtctttctaggttggggaagttctcctggacaatatcctgcagagtgttttccaacttggtcccattctccctgacactttcaggtacaccaatcaaatgtagatttggtcttttcacatagtcccatatttcttggaggctttgttcgtttgtttttactctttttcctctttgtcttctcattttatctcattaatttcatctttggtcactgatagcctttcttccacttttcaaattggctactgaagcatgtgcatgtgtcacgaagttctcatgccatggtttgcagctccatcaggtcatttaaggtcttctctacactgtttattctagttagccattcgtctaacctttttttcaaggtttttagcttccttgcaatgggttcaaacatgctcctttagttcggagaagtttgttattaccaaccttctgaagcctacttctgtcaactcatcagtcattctccgtccagctttgctccgttgctggtgaggaactgtgatcctttggaggagaggaggtgctcctctgatttttagaattttcaacttttctgctctggtttctccctatctttgtggttttagctacctttggtctttcatgttggtgacctacagatggggttttggtgtagatgtcctttttgttcatgttgatgctattcctttctgtttgttagctttccttctaacagtcaggcccctctgctgcaggtctgttggcgtttgctggaggtccactccagaccctgtttgcctggctatcaccagcggaggttgcagaacagcaaatattgctggctgatccttcctctggaagcttcctcccagaggggcacccacctatatgaggtgtctgtcggcccctactgggaagtgtctcccagttaggctacacaggggtcagggacccacttgaggaggcagtctgtccattctcagagctcaaacaccatgttgggagaaccactgctctcttcagagctcagttggaaatgcagaaatcacccgtgttctgggtcgatcatgctgggatctgccgactggagctgttcctattcggccatagttccatgtagctgggagaggcctcacaattatggcagaaggtgaaggcacttcagtggaaagcaggggctccaacggggtaaaggcatgctccataacagattattggcctacaatagcgggtggagccacagagttgggagcacaggctgcgggagctaaggcgattgactgcttggcatgcggctgaggagcctctgggatatataaattttcaaaatttatttaagggttatggaatcaatatatttaagtgatcctgaagacatgttttcatcttacatttatgaaatttcttcaaactccttataaaaattaaaataaaacatgattgtttattttcctttccacaagtctcgtaactctacaaataaagaaaattaacttaaaactatagttaaccaaaactatatttcataggccgttagtctagaataatgataagtaatacacacatacacacacacacacacacacaaatagaattgttctgtgttcaaatactttgctaaatacctgtttcccatatttatttagccatagaacagattttttaattccagcaccattctattaacatttagtattctgagggacaccagtttgagtaacactggtttcgcataatacattcttagtgaatccacattgacttttagtaacatccatttctttttccaaagtgctttttaatacatttagaatctttcttagacttccactcttatgttcaaataaataaatcatattcttccatcatcagtcttctgaactctcttttattcttcttagtaagattactaatagttgttgatcagtttcatttactaatcttctcactacttattctaagttgttcccccctaccttgtacagcttgagaattatgacaagagtatcatgtgtgaatgcagagtctatttataagtttttggaatggagtcatatactacatatactataaagcagataaatgctactcttaggaaaaaaatacattgcagaaaagaacacttctatttctacactacaagactttaaaatacttattaaattatttattatatggcaagcagtgtgtattttatgtactttcattttttcatttaactcttcatagaaatcctatgaaataggtattattatccttatttgatggaggataaatctaagacataatatttaagcaatttgctcaaggtcatgtaactagtaaagagagaagcaatgtttcagaagtagatgtattttattctatgtttttaactactatgctatactgcctccctgaggacaaactttatatttattccttagtatctcagaatgcctagtatagtagttgctcaaaaaatatttactgaatgaataactatataaacaaatgtatttcagctgggtcaagggactttcatgcattcaaagaatttatgtactctaggaaaatatctctttccatctttaaacgcctatttactagtgttattctacccttatcagtctgtagaagtctgtctaaatactatgagtgtctttcaaaattaattcttgaaattctgtaaattaaataaaaaggaaaaggagattttaaaaacagcttaacagatttctgcataccctttaataaaggactgtatgatgtgtgaggtctctgtggataaacacataagtgtaataaacatttttttaagatttatttcttattttcctataatgagactattattttactagagagtgatcatcttacatatgataatattaatatcttttgttaacttaggagaaattacagaaaaaaatttctaactttatggaagtctctcagttcactgtcttaatttaacacatatctccaggagttcacatcataaagacaaacaaatctaagtgagtaattctaacataagataacgataaatgcaataaaatagacacaagtaagatgttatgggaagagattcactaagataaggtggacttgaaaaggttacattcattcaaagacagtttactggataactaccacttgccaggcactgtgctcattatgagagagacagcaatgccttaaaacaagatttctacactttaggagttcatagctttgtaggaattaccaataagaaacaaaaagtatagtactcactgaggagtgttatagaaaatagtatatatataaaacacacaaaatagcgtggaagcacaagaaaaagaaatattaaatcttcttgagagaaatggaaaagatttgctgaggagctaattttcctattttaaactgtttttatttatcttgttttcaatgtgtaatatagtcacatgtctcaaaataaagcaacataacaaggtttctattcagaagtcccatttctatcctttctcaatctacatggctcctcctacccctccattaactgcttttattcaatattgtggctacttcgagtgtttctttatgtaaaagcaagaaaattatgacatacttcattttcatttccaacctttatttattacaaaggtagtatactatagatactctacctttccttgctttttttcactgaactctgtatcctgaaaccttctcatatcagtataaataaagagcgggtcttcattctttgtttttcaaacaggtgagtagtactccattgtatgaatgtaccataacttatttaaccagttctctgtgatgtacatttgagttatttctaatattttattaatccaaacagtacaccaataaaaagttttgtatatatgcatacacaggtatatctgtagacataaattctagtaggattgttgactcgaacaaattcatttgtattttttataaatattacaaaattaaccttcatagggattgttctaccaaaatatatgagagtgcttacttcctgaagtttattgctgaacattctttttcattgtagtttaatccatatttctcttttatgagtaaggttgagtatttttcatatatgtcttatcagtttctaaaagtaggaggattaggtcttatctgtgatatcagttgcaaatattttttccagtttttcatttgtcatttaaaatttttttatcatgttatgttttatgatcatgtaaattttttgtttatttgcttttaaagtagttgatattatcagtctttgtttctttggcctggactttttaccaaagtttaaaaggtctttcctgtcactcaattatacaaaaattcactgtttccttcttgttcttttatagttttttttttttacattgggtgtttttttctgggtattcagtgtacataacaacaatctctttacatgtattctttcctttgcttttttctggaatactttaaagcaaatttcagacattatgttagttcactccttaatatttcagagtacatatcaaactaataggacttatttttccacataaccacccagttattaccatacctaccaaaattaacaataatgttttaataacatctaatacccagcttaggttaaaattttcctaattatctcaaagatatcttcttccaacttttttctcatcagcatgcaaacaatgtccacacatttggtttttatgtttcttatgtttattctacagtcccctgtttttctctctattgtgtacataaatttaaagagcagagggaaaaaccaaaagagtgaagtgttgctctttgaaaatggatttacagcctcctcaatttttttttttagggaaagaaagatgatttaaacaagcaaataatatttacctttgttcaagcacatttaattttatcaagacacgattcataagaagtaatttgtttttaatagagctacactttatggaattaatctaggattctttaatttgtttcttgtgaacattcttatcggttttcattttacatacttatcacttatttcaaatattttcttataggaggacaaaataatttcagtaatgtatcataatttgggtacaatatgtacaatgaccctgaaccagtgtgattggaatgtagtgatcaagggttggagtgacttgagatgaagtacaaaaagagaaacagatgctaaaccatgcagcactttctagggccattaaggattttagtttttatcctgagaacaatggtgagttatcaaaaagttttaattttccagttgtatacctttaactcaggaaaaccacggatatttctatgtgtgattaactatctcacataaaaatatacaaggaaatgtaatctttttggctcttattcataaacatgtgattcaaaacaatgaattgttaaataactgagtaaattatgttgtcaagtctggaaacatggcatcacatttctgtacacatttccactgacttccaaagtttatgtagaactagaattgacctgctacctgacacattcagagttcaaaagtttctatttgaaagaaagttatatttataaaaatcaaaagtttatatagtcatattttcaggtgttaacttcagtcctattcatttttcttcttacttacctaaaattcatgtttttctgtgataaaagctgaaatcttatcatctttggttggtccatttataaaatcccaagctctcatatgcagatctccaaagtgttttttgtcactgaatattcaccaaatgagatttaaggaactaacagtacacaaataagatgttagaataaaaacacattctcctgagtctcaatagcgatgtgttattcttgtgacagctgtatacatttttccacactcatttcagtctctcaaaatcaacctccctggaaggcagcatattataatagagagaacatcaggattgaagtcagtttgaacaggatggcaaatacaattctatcacataattgctgtataactcagagagtcacaatctctctgagcctcagttttaacatctacaaaatggcaataatagtacctaatgtgcagggttgctggaaggattgagtgagatagtttaaaggaagcatctggcacatagtagatgctcaacataattatgatgttttcttgtggtatttatcattactaatgataatagagtggggaatttgagatatgttagcgtttcctattatatatattaccagatagctgataatacctcattgataattggtatatttaatcaactatatatcttgttgataatacctcattgacagcatttgaaggatcattgattttactctttatgtcctgggtgcacccacttatagttttataaattaggcaattaacattactagacaaattgattatgcctgattttgattcattttcttaatacagtttacttttatacacttattttcttactagaaaaggaatataaccataattgattttcatttcacaggctacatgataatggatataaaatagagttatgttaacaatcatcaaataatttctctttgactctaacccatttgttttaaaaataggtagtgcttgctctactttgctctattcatggactcagtgcatcacaaatagttttgcaagtacttaagggacatgggtatctctcagatgccgtgagaaccagtcttcttggctactatgtaatgactcttattttcttctccttgctgtagtaatgcctcctatgccaaaagaagctatggaatccattgcctcttaagatatctctcactactgatgactgttgaaggttattgctgctggtggtactcctccatggttttttttttttttttttttgagacggggtctcactctgtctcccaggttggagtgcagtggggcgttgtcagttcagtgcaacctccgcctcctgggttcaagtaatcctcccacctcagcctctcgagtagctaggactacaggagcgcaccaccatgcctcgctaatttttgtattttttgtagagatgaggttttgccatgttgcccagctggtctacagctcctggactcaagcagtcagcccaccttgacctcccaaagtgttgggattactggcatgagccattgtgcccagacaatatttttatactaaggctgctgatgtccactctccttgcctaggagggatatctttgtttttttcttgatatccctctatggctaaaacatgaatctctataaatgagctggatcagtaacaaatctaactgagggatatatgcctattctgtaatttgaatcaccctgtctaatgggactggccaatcatctttgaactcatcttgagttctgtgactttctcttccctaaggacaaattatttaacaaaggttatttggcccgttaggtagctaggatcttggcattgttttttcaagcagttctccaagtatgctcagacatgttaaaagcctaagtggaacagtggttgaggatatgctgatatcccctacaacttttattatactcttccatgtataaaaaaactttatagtacatgttacagtctatatcttcactcatgaattggctcttccaagaatcagataataagcagccctttatctgggcactgtaagcttggttaataggctcagattctcacataccaaatcacatcctcccccaggataaccagagtgatagaacaaaactgggctattatccaggtttcaaattactcctagtgtgaattagcactctttttcaagatgagcattttcccttcagttccttgttctcttaccttagagacacaggcctccaggttttgtttcttctagaaattcctgaggcctctctagaaaagcctatgttcaaagaccactgtccattacaaagtctatgggtatgggtaggcagactcccttacttatgatgacaaccactccaatctcatttctaactctctctctagcttagtgtctctgtttcccatggaaatgagacatagtcaactgtaaacttttcctaggcaaaagacagcctcatccaccagtcttagttcccaagcactgggatcacagacatagaaagtcttctccccaattaatttatagttaataaatcctacttgtagacccgctgtattagatccatcctatttcctgccaactgtttttatacaggctgtggccacaaactttagccccactatataggatgtaagtgtacccctgacattcatttcatactgaaaggggagacgcaaagtctacaatagtactcatcacccatcttgaagttactggtaccaaacttgagcactgacagtactgttgtgactcacagcggtatttcatctgggaatttccaggtgtagtttctcacttcacttacccacatgctagatcaagcttattgaatctccattctcaatagccaatccaaattaggggtctgtggacagtcagccccccaccaaataccccaaagtaaaaggtaaacaaagtgggcattttttagaaccttcatagccacatgataagaatgttatgtgctggttccattaacccttttctctgcccccactgcctgcttcctagtatgtacagcaaagtccaatgaaatattttaagttgtgaatcataaagaggatgttctggatttttgtgtatccactacctctagagtactttgcataatagtccatatatagaggtcacctggaatacttcgcataatagcctatagagagagaagcatttcttccataaaatctaggcaactgtgattagagccctttaatttggggcatgatgggtaaaagaattggtttccaagagtctgctcccacaagttctgctatctggttttaaaaacaagaagtctttgttcattaactctatgagcttgccattaaggattgtttccagataggctgccaaatttggaggtcttttgcagtatgcagaagtttcacagtgtatttaatgtcttcattcacccctggcaaacaaaacaaaaaaaaaatccaggtctaaattagttctagggtcttttcttttttaatagtcacagccattgcttaatgctctcacaagtacctgctcatatcctctgagaaaaataagatgcataaaaaaatcaaatgtttctacttcccttacatagaccaatgcaaaatataacttaattcctggcttactatttttaacttttgtcattcttaaagtaaaatcttagtcacactagaagaatatttttcaaagtgcagatcttaatccactaagctattaaatcagttcagttggtcaaaaacagtatttttataaaaggaagtataagatagaaaaataaatataagaatatgtggcatttagaaaagtaattattttgtgaaacttttgcttcagttatatgtttgtgtgtgtgtgtgtgtgtgtgtgtgtgtgtacacaaatatgtttgctggataaagccataaaatgtatttcatttgtggatagtagtcaaaataattgaagatttaaaatccactgtcatggaagagtcaccaatccccaaggtgtagaaggcctttttctcttagctcatcatgctgtcctctaccccatatgttgaggcaccaagagtttatgcaaggcaacatagctgatagctactacagatactgtctgtaggttgtcctaagttttcaaacaggcttgccttcccagagtgccatgtactctgggaattccaaataaacctaattccctccaaggggatagtttctatttcccgtaagtggaacacttgagatgacatatgcacacctttcttgctaatcttggccctataacatagattgaagccttaaaatgatactcagagaacatcaccacccacttatgcctagtgatatctattctgaaagtggtattcagtcccctctccaagacgagcaagttgtcggagacaataaagaccaaggtaggatgtggtattctgggagtcagtgccagcaattatactgaaatggctgtttgggaccttgttgttcatgtagctgggctgactgagtccaagaatgtatgagactttgcttgaacctttctaaagttcttctttgcatgagtctctcttgaatagcatcaccatggaactagtgcttttctataggcattttcaaattggctatacccaagtggtttgggaccttaaatagccagcatccatgttcttccagttgcggaaggcattgctgtcattcagtactacctatacctcaaggtagttcatgtaacccactgcatttccattaggtgttgtggagtggcagaaacttttgttttccactgacatatccttttaaactgataaagatcatttttaattcatctttatcaactcttagaatctggtgattcatgttctacaaatgtaatacagcgatttactagctttctgataagccactctgtgtatcttatatcagccatagtaattatgtatgacttactatgcatatgcatacatacacaaatagaaagtatacatatgtagtaactatgataatctgtgcccattgaaaaatttccagtttcttattctctcattaccataatagatgaggtatatatatatatggaaagaagaatttggtaataatcccattagtcaattacctttaaaatgatttctcatatcatcagtctgatatagcaattctcctagatcagtcgctattaactgggggcaattttgtcattcaaaagacatttagcaatgtctggagacattttggcttgtcacaactgaggcagtggtgctactggcatctagtaagtagagggcacggatactgctaaacactatacaatgcacaaggcagtccccatctcccccacacagagagagaattatttggtcctaaatgtcagtggtgctgatgttgaaaactcctgttctgatcctaatatttttgttgttgttgtttttaaggacttttaaccaaaataggtcaccaattaactgcagctgatatctgttattacattagcatttagagcattaacgatataatcatttatcataatacacaaaaaaggtagaacaagaaagaataatgtagcttttgtatccatggctgatcctgacgtttgaccctgacatttacttaagtcattcaaacatagtgggctattccttttttacacacttctattcatagagagactataccatggcaataaccctgatcttccttctcaagctttcattcaacttctcagaacttgaagagaccccagtctcaaaattaagttaacttacgtcttagacttggaattttataggataatgccctggaggaaaatagaaaatgagagctgtttgtttctctttgtctctaacttctggtgagctaatgtgtataagacaagtaaggggagttttgttaaggatctatcatcagtctactgctggaaataatattctgggactcgaaaaggctaaaattagcctcaatcaatgttatatacactacaacaggcttgattcagctcatctcagtggcaaatatgggggaaatataatgagttcaattttaaatatcatgagtttgaggtgcctgtgagtcattcaagcggagatgtcaagtaggtaattgagtatatggaattgcacgtataaacagaaatgtaggcatcatcagcttatagacagtaattgaatccatgggaatggatgagaccaactaaggaaaaaatacagatttagaagagaaggtagcccatactgaattcttaggtactttcaatatttgatgtcagataaaggattattccaaaatcgatgacctttccactatatcatgctgtctcccagatagaaagtgagctgcatttaatcattcaataaaatttcacattaagcacctctcatatgccagacactattgtaggcacttgggatacatcagtttaaaaaaaactgacaaaaatctcagagcttaaaagaggttatagtctagtgagtttctttataatgaaacaggggcacccttccacagctcagctgatagagtggaagactgtgggggttataataaaacaagggttacagaaggctttacttccctgctgtaaagcctctaaacccctgaaactctcaatcccctcaccttcaatattagaaagaaatcttagacagcatcttattcttccctttcccctactccagcttctttgtttggtactgcatgtgactagtttttatacaaatttgccagttgccttgaacaaatagataatagagcaaccaagaaattagagagacattgaccttgggtgaaaggaaaaagaaagaatgtcacataaaaaggaatgagaggcattcataataaaataaataacattataggcccaagttaagataagtggacaaagaaatctcagttcctagattgacaaaatataacaaagttgggaaaacctagcaacaaggtattagagagagtgagggtaaggaggtggtcctggtttgaaaatgctagcatgcattaggaaggaacaattagaggaaaatgtggtaaactcacacagctatctttctgattctgtatctttcttattgttatcttggattcagttttactcccatcaagcaacaaattgatgtgagtcacaccacataataaatacattgaactaaaatttcatgataaaacttttgacattctcagcactttaaaaatagctctgttatttgaggggactgggattcacttagggaaagagcacagtaacacataaagacagcttttctgctgcttcttaaaatagcattgattgtgttgggcatctatctgcttttgcacatctctgacatttctgttccaacccaggggccacttttaaacaaatatgaaactacagagctttatgtggcactccaaggacacttgtaaaataattatttccttagttctttgccatgcccctgactgcctagaattgaaggcctatacaataaataacctgtctcagatctcaggaggatattagtgtacaaatcagtgaatctcaaatggagatcgcataagaatctccaggatttagggactttttaaaagtacacattcccccatcctatcccctgtagattattatgtatacctcttatccttacacataaaagttacttctatagagagacaatattacttatgagaaaaggtttcattccttaggttaggaaggtagaaaggttgaagaatactgacgtgtttgacatttttaaatatattccatagatacatctctctaacaaactcccagttccagcagtagtgagttttctatatcagtactgtttccagactaaaacaaacaaatcatcaaaagtctagagatggaattcctcagccagaactgtccagtagaacattctacctgtctgtctagaacttgatttaagattcaagggtactggctatcaggtattgttccagttactatttctatgtgacaagtcacccaaacttagtggcatacaacaattgattcattaatctcagattctgaatcagggtcagaaatttggaaaggacacagcagggatggattgtttgtgctccacagtgtctagggcctcagctaggaagactcaaaagtctgaaggctaatattgtctaaagcttcactcacttccatgtctggcagttgaggatgctgagtatcagtcatgatctcagctggggctgtcagctgaaacacctatgtgtgacttcttcatgtagctgcttggagttcatcacagtatagcaaatgggttacaagaacaagtttccaaagagtcatggagtaaactagctttggaagtcacaaaacattacttgtaccaagtcacaattacactcagattgaatggaggggaacgcagaccccatttcttgatggaagaaatgtcgaagtcacatgttcaaaagagcatgtgggattggagatatacagtgtagtcatctttggaaactacaatttgctataatctgcccactaggtacaataactaatatcctcccaacattcaaagtattctaattccctcctccaagacctctaagtcgcataatgacagcagctcaactacaaggtctcattttctatattaggtccaggtgcagatgaagatcctaaggtttgattcttttgagtacagttccataagcacctcttgacctgaagacatgcaagctaaagttacaagttacctgctctacacattcaacataaaattatggggccaggcctagaataattgccataggccctctcatggaaatggaagaggggatggaaagactgcagcagtcactagttcataacaattctgaaatatagctaagtacatattgccagttccttgttttgtcctactgcttgagatctactctctattacttctcactctgcctctagtctcttggttccattttctgtgtcatctttccttgtttcataaaaaaagcttatgtttgcagctgagtggtttttttttttttttcagtttgttttctcctgtagtagtctggaagtccaaagcacttcattttgtactatctctatccttttaagtccaacctattgcacaattccttgaaaaattttctgtgtaccaatttataatccactctatcagacaaaagccataataagagatttccattgttttttctaccttgggctccctgtgaggctgctgtggtataacccccttaaacttaaaagctccatcacttagcaaaaagagatctgtatctgtccttaagatccttagaaggcctttgttctgtctgaaaggttctaggaggcactgctttacatatttttgaggctttaacaaagagtcccaacctggtttttatctttagcacagagccttttttgatttgagaatctctgtatggagagactgggaaagtgaaatagtattgtattcaaacttaccaagtactgcattctttataataagagtcaaacctttagctcgtatatttccttttgcgttttatcatatgcagtgaaaagaagccaagtggtattttacacatctctatagctagttcatcaagtttactaggtgtatcctatttttcatgttaccacagaagggtgttgctgactttctgctactaaagaacaaggtctccctttcacagagcttccattttttcttactttcctttaagccctcaccaacagcccctttaaggctctgaaggcttttttctatcactctcttcaagagtctttcgtactcctctgcttcctggtccacacattttcaggttttcttataacagcactctacttacaggtaccaaattatatttcagttagcaataattgagtaacaaagcattctaaacttagaggcacaaaacaacaacaattttattatgcttacagattctttgggcttagaatttggaaagaacataacagaaatgtcttggttttgctccaaaatgtctaaggtctcagctgggaatactcaaagactaggggataggagcatttgaaggcttattcattcatatatctggcagtaaatgctagccattagttgggccagaactcctacctgtggtttttccatatcactgattgaagactttatttatagaaataattttgagggtactcattaacatgtgtccaggggtcagtcgtcacaacttggaacatcagatcagtaaggaagcacagctcatatttcacacaatgggcaatattcttggggcaattcaagttcaaacacgcacatactaggtaaccaaaacttctgggtagatgcattatcatgccatccaggatgacatggggtagcaggagccacttaaccccagaagatcctctactctggaaattttataattgtctatcaacagttggaaataactcatcagatataaacaatcagcagatgattatatatgtccttgcttgaggtcctctgtgaaagacaccaaagttgtagactgaactaggaacacattccacagaatgattggttgaagatgtccactcaaaaagtctgcacacaagcactatttacaataacaaacacatggaaccaacccaaatgcccaacaatgataggctggataaagaaaatgtggtacatatacaccatggaatactatgcagccataaaaaagaatgagatcatgtcctttgcagggatatggatgaagctggaagccatcatcttcagcaaactaacacaggaacagaaaaccaagcaccacatattctcactaacaagtgggagttgaacaatgagaacacatggacacagggaggggaacatcacacaccagggccagttgtgaggtgaggggcaaggggaaggagagcattaggaaaaataggtaatcaatgtggggcttaaaacctagatgacaggttagtaggtgcagctacccatcattgcacatgtatacctatgcaacaaacctacacatcctggaactgaaagtaaaataaaaaataataaataaataaaaagcaagaaaagaaaaagaaaaaagaagtctgcacacaagttatttgcctctggacattaccacagggtcttgttaatacactgatagtaaattttctgggatttctattgatcttatatcaggaatgatgtcttcaatatgccacaaattttcctgaatcaagaaacacccaacaaatcctaaacctgctaagatatctttatcaaggttgatatgggattgagaattgagattatacagtaaatacaattctgaatgggctgtcttcatctacaacaacatcacaagcattttttcatgtaattgcattattttcataactagaaatattaaattcaacagttttcccttaagatttaattgcatacaaatatttgaatgataaaaaactcaagtatgtcaataaattatatctacatttcaaatctcagagatgaatattgtatagggattcattttgaagtaaagaaaaagtactcctttttaaattaatacattaaaagttgtgcttttatcataaatatattttttagtattaaaaaactgactatggctcatgcctgtaatcccaacactttaggaagctgagaggggccatggtttgagcccaggagtttgagaccagactggacaacatagtgagacactgtctctatcaaaaaaaaaaaatagaatttcacaggtaagttaagtattaaccaagagagacaaaattatcctaaaacttttgtttacctccttaactaccatttgaattctccctctggctcaaatggttattgattcatcttatcacccaagatgctttggccctctgggtaggactcttattgaactctccacaacttaaataggacatgatcgtcatattatgaaacccatagttttagaagcactacacgtattgatagagatgagctgacagcatttgtgcagacttttctttttttaaatttttatttttatttgaagttctggggtacatgtgcaggatgtgcaggtttgttacataggtgaaagtgtgccatggtggtttgctgcacctatcaactcatcacccaagcattaagcccagcatgcatcacctatttttcctaatgctctttctccccacactctatcccccaataggccccagtgtgtgttgttcccctccctgtgctcatgtgtttccattgttcagctcacacttacaagtgagaacatgcagtgcttggttttctgttgctgcgttagtttgctgaggataatggcttccagctctatccatgtcccagcaaagaacatggtctcattcctttttatagctgcatagtactccatggtgtatatgtaccacattttctttatccagtctattattgatggacatttgggttgattccatgtctctgctattgtgaatagtgctgcagtgaacatacacgtgcatgtatgtttgtaatagaatgatttatgttcctttggatatatacccagtaatgagatttctggaccaaatgctagctacacattatacaaaaattaactcaagatggattaaagacttaaatgtaaaacccaaaactataaaaaccctagaagaaaatctaggcaataccattcaggacataggcacaggcaaagatttcatgacgaaaactccaaaagcaattacaacaaaagcaaaaattgacaaatgggatcgaattaaactaaagagcttctgcacagcaaaagaaactatcctcagagtgaacaggcaacctacagagtgggagaaaatttttgcagcctatccatctgacaaaggtctaatatccagaatctacaaacaacttaaacaaatttacaataaaagaaaaccattaaaaagtgggcaaaggacatgaacagataattctcacaagaagacattcatgtggccaacaaacatatgaaataaagctcaacatcactgatcatcagagaaatgcaaatcaaaaccacaatgagataccatctcacgccagtcagaatggtgattattagaaagtcaagaaacaacagatgctggcaaggttgcagagaaataggaacacttttacattgttggtgggaatgtgaattagttcaaccattgtggaagaaggtatgcagtcttttcattaggacaacactggaaggtaactaagcaatttttggaagaaagcaattatagaactattggttttaatcaaatgtcttactcatacatctcaggacacaacatttgcacattttttttcaggtatataatgccatttaaaacattttacttggctgggcctggtggctcacacctgtaatcccagcactttgggaggccgaggcaggcagatcacaaggtcaggagatcgagaccatcctggctaacatggtgaagccccgtctctactgaaaatacaaaaaaagtagccgggcatggtggcgggcacctgtagtctcagctacttgggaggctgaggcaggagaatggcgtgaacccaggaggcagagcttgcagtgagccgagattgcgccactgcactccagcctgggtgacagagcaagactccgtctcaaaaaaaaaaatttattttacctgggtcagttgataaaattttttatataactccaggaaactcaggcctcataattctgaggaaggtggaatattttaaatatcctatttgatggaaaatatatagactaggtcattctgtccataggtccctatgccatacctatgttggattagtattagcactctggagggtatgtgagttcttgtttatgaggagacgccaatactttcaaggtaggggacagacattgtttaaaagttccagttttggaaaagatgtgctatggaataatgctgccctaaccatgacattcaaggaaacgctttcgacacttttatgtgaacaactgttatagatctctaaggctggtcacctgggatctgtatatacagctgaaaggctacccggtcaaatgcatccacctcttagacatcctgtttcagtctagcaccagctatgactgagtaaatacactagcagaaaacaccttattgcagaaaattcagccactttatgtaaaagtgtgccaggcccactggcaagaaatgctgcagctactcagtaatgataaaatcagctaagccctcctgctttagctttatctaaattaggggggatcttggctgcccatatacccacacactggcagatttcaaggcaatgggaaacttaataatggtccagcagacccagactcacttcaaacctctgccaggctttgcatacatgtaaaggcaatctgcttccaagagagacccactatctataagaatctactagggtagaaaaattcatggaggttctcatgctcatgttggtacttaaaacttaatagttctaggcccataagtgaactataatcagaagcatcctgaactacgagcttcatcttaaacaactgatagtatcagtgcccacaggttattcaggggtgcctgctttatcaatcacactgacaagcagagtgcaagacaagaaatcaatcttcggagaagccatctctcaacagaagacagaagagttaccccatttattcagttattaaatagataattattgtaaacttactatgagataggcccttgggatacagtggtgagcaaagtagacaaaaatccttgccctatggagcttactttctagagcaggagatagaaaatgaaccaaataaataagtaaattaaattgcttattgaaagtgataagtgctgtggagataaataaagcaaataaagggaatacagagattatttttcaaataagtcatcaggaaaggtctcactgagacactaatatttaaccaacgacttcaagtttgaagttggaagacccataggtgtgtagagctctagacagagggaccaagaattgggaatttcaactctgatttaaactttaggctgaggcctcagtcattttgattaaataaaaagtgaatcagcatgatggtagctgttgctaatatgtgttagcctggcttcacttctgtccataccttggcctaccttgatttagatcacattcacatagtacaatgtctgctcccattactactttggaggcaaacatattgcaggaggataccagccacaccaataactacaatgaccatttgatttttagaaaacaaaatgacattgagtattttggagaacaggttgacaaattctattccataagccaaactcatccatttttttaattgaaatttttgttgagagaactatggattcatatggagttgtaggaaatattagagtgataccatatactttacccagtttcccccagtggtaatgactttcaaaactatatcacaaacaggctatttacaagagacaatcctctgaccttgttcacatttctacatatttttatgcactcatttgtttgtgtgtgtgtgttaagttctaagaaattttatcacaaatataggttcatgtatacactatcacagtctagatacaaaccaactccattatgacaaggatccattatgttgtgtttttctaactactgcccccagctccttcccaattactaccctgttcataatccctggcaatctgttatttatttctaaagttttgttatttaaagaatgttttaaaaaggattcacagaatatgtgatcatttggggttggtttttttcactcgacttaattccctggaaattcattcaagctattggatgtagcaattgttcattcctttacattgctgtgtagtattccatggtatagatgttccatagcttaaccattaacacattgaaggacatttgagtttttactgtttgtggctattatgaataaagctgctacgaacattcctgtacagctttatgtgtgaacataagttttaactctccagggaaaaatgacccagagggcaattgctgagtggctgtgccattttacattctcacctgcaacatatccatgatgcatttctccacattcttgccagaattttctaatatctctaatttatattttataattatattatataattatataaattataatatctataatttatatattatataatcagccactctctaattacatattatataatcagccactctctgattacttctaattttctaatgggttgtaaggagttttttggttaagttttaagagtatatatatatatatatatgtgtatgtgtgtgtgtatatatatatatatatatatatatatactgatatatactgatatcctttcttttaggcatatacccggcagtgggattgctggatcatacttttagtagctctatttttggtagctctatttttagtcatttgaggaacttccaaactgtttcctacagtggttgtactaatttacattcccaccaccagtgtacaagggttccattttctttacatcctcaccagcatttgttatttgctgttgtttttggatataagccattttaactgaggtgaaatgatatctcattgtagttttgatttgaatttctctgataatcaatgatgttgagcaccttttcatatgcctgtttgccatttgtacgtctccttttgagaaatgtctattctaatcttttgctcatttttaattggattattatacttttttttcctatagagttgtctgagctccttatatattctggttatgaatcccttgtcagatgggtagtttgcaaatattttctccaattctgtgggttatctgtttactttgttgattgtttcttttgctgtgcaaaagctttttaacttgatgtgatcccatttgtccacgtttgttttggttgcctgtgcttgtgggagataatgctcaagaaatttttgcctggtctgttgtcgtggggagtttctccagtgtttctttgtattagtttcacagcttgaagggtcagatttaagtctttaatccattttgatttgatttttgtatatggcaagagataggagtcaagtttcattattctgcatgctgatatccagatttcccagcaccatatattgaagagactgtcttttccccagtgtatattcttggcagctaccttaaaaatgagttcactgtatatgtatggattaactctgagttttctattctattcctttggtgtatatgtctgtttttatgccagtaccatgttgttttgattactaaagctctgtagaatttaaagtgaggtaataggattcctccagttttgttctttttgcttaggataatttcggctatcctgggtcttctgtggttccctataaattttagaatttttttctatttctgtgaagaatgccattggtattttgataggggttgcattaagtctgtagattgcttagggtagtgtggacattttaataatattgattctatgaggtatttttccttttttttggtatcctcttcaattgatttcatcttgttttatagttttcattacagagctctttcacttttttggttaagttaattcctaggtatttaattttatgtgtggctattataaatgggattacttttttaaacttcattttcagattgtatgtagattttgtatcctgcaacttttctgaattttttaatcagtctaatagttttattctggagtctttagtttttttcaaatataaacaaggagatacatatatatatatatatatatatatatatatatatatatatatatatatatatatatagagagagagagagagagagagagagagagagaggcagagtttcgctctgtcacccaggctggagtgcagtggcttgatcttggctcactgcaacctttgcctcccaggttcaagcaattcttgtgcctcagcctcctgagtagctgggattacaggcgtgggccacaacacctagctaatttttgtatttttattcgagattagggtttcatcatgttggccaggctggtcttgaacttctggctttaagtgatctacccacctcagccttccaaagtgctgggattacaggtgtgagccaccaagcccagcctgatctttttagtgtattattgaactcagttttgaagtatttcgttgaggatttttgcatcaatattcaagagagatattggcctatagttttctttttttatttttttattttttttaattattattatactttaagttttagggtacatgtgcacaatgtgcaggttagttacgtatgtatacatgtgccatgctggtgtgctgcacccattaactcgtcctttagcattaggtatatctcccaatgctatccctcccccctccccccaccccacaacagtccccagagtgtgatgttacccttcctgtgtccaagtgttctcattgttcaattcccatctaagagtgagaacatgtggtgtttggttttttgtttttgcgatagtttactgagaatgatgatttccaatttcatccatgtccctacaaaggacatgaactcatcattttttatggctgcatagtattccatggtgtatatgtgccacattttcttaacccagtctatcattgttggacatttgggttggttccaagtctttgctattgtgaatagtgccacaataaacatacgtgtgcatgtgtctttaaagcagcatgatttatagtcctttgggcatataccgagtaatgggatggctaggtcaaatggtatttctagttctagatccctgagggatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcctcttttgagaagtgtctgttcatatcctttgccgactttttgatggggttgtttgtttttttcttgtaaatttgtttgagttcattgtagattctgaatattagccctttgtcagatgagtcggttgtgaaaattttctcccattttgtagcttgcctgtccactctgatggtagtttcttttgctgtgcagaagctctttagtttaattagatcccatttgtgaattttggcttttgttgccattgcttttggtgttttagacgtgaagtccttgcccatgcctatgtcctgaatggtaatgcctaggttttcttctagggtttttatgtttttaggtctaacgtttaagtctttaatccatcttgaattgatttttgtataaggtgtaaggaagggatccagtttcagctttctacatattaaaaggtattaaattaggaaaagaggaagtcaaattgtccctgtttgcagacgacatgattgtatatctagaaaaccccattgtctcagcccaaaatctccttaagctgataagcaacttcagcaaagtctcaggatataaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggatctcttcaaggagagctacaaaccactgctcaatgaaataaaacaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctacatcgccaagtcaatcctaagccaaaagaacaaagctggaggcatcatgctacctgacttcaaactatactacaaggctacagtaaccaaaacagcatggtactggtacaaaaacagagatatagatcaatggaacagaacagagccctcagaaataatgtcgcatatctacaactatctgatctttgacaaacctgagaaaaacaagcaatggggaaaggattccctatttaacaaatggtgctgggaaaactggctacttttcttttttttgatgtgactttttctggtttgggaatcagggtaataatagccttgtagaatgaggttggaagtattccttgtgcctcaatttatcagaatagtttgaataggattggtgttagtatttagttaaatttttcatagaattcagcactgaaaccatcagcttttctttactgggatactttttcttacggcttcaattttgttacttgttgttctgttcagggtttggatttcttccttgttcaatttttgtaggttgtatttgtctaggaatttgttcatttcttctagattttccaatttattggcatatagttgctcatagtagctactaatgatccttcgaatttctacagtgtcaattgtaatgcctcctttttcattttccatttaattgaatcttctctctttttttcagttagtctgcccataggttcgtcaatttggtttaacttttcaaaaaagcaactttctgtttcattgatcttttgttttgctttcttcatttcaaaataatttattactgcttttatatttttaattttcattttgttttgtttttgtttttgttattgttttgttttgttttgcaagacagagtttcactctcagtgcccaggctggagtgcaatggcacgatctcagttcactgcaacctccgcctcctgggttcaaagcgattctcctgcctcagcctccctagtggctgagattacaggtgtccgccaccatgcccagctaattttttgtatttttagtagagacggggtttcatcatgttggctaggctggtctcaaactcctgacctcaggtgatccacccgcctcggcctcccaaagtgctggggttacaggtgtgagccaccgcacccagcacatgtgtttttacagttcccaaaattccttatgttatggatttctaattttattccattgtgttcagagaggatgcttgatattatttcaattttagaaaacgttttaaaacttgttttgtgacctaacatatggtctattcttgagaatcatttatgtgctgaggaaaagaatgtgtattctgcagccgatgaatgaagtgttctgtaaatatctgttagaatcatttggtctatatagtgcagattaagtctaatgtttcttttttgattttctgtctggaagatctgtacaatgctgagagtggggtgttgaggtcttcagctatgactgtatggggacctatctgttgctttagccctagtaatatttgctttataaatccaggtgctccaggttgggtgcataaatgtttaacattgttaaagcatcttgctgaattggtgactttatgattatatagtaaccatctttgtctcttgttatagttttgtcttgaaatctattctgtctgatgtaagtatagctactcctgtgctttttcagtttccattggcatggaatatatatttccatccctttatgttcacgctatgtgtgtcttcataggtgaattgtatttctttcaggcaacagatcaatgggtcttgtattttttattattatacttcaagttctggggtatatgtgcaaaacatgtagattagttacataggtatacatgtgccatggtgctttgctgcacccgtcaaaccatcatctacattagatatttctcctaatgctatcccttccctagcgctccccaccccctgacagggcctagtgtgtgatgctcctctccctgtgtccatgtgttcaactccctcttatgagtgagaacatgcagtgtttggttttctgtgcttgtgttagtttgctgagaatgatgttttccagcttcatccatgtccctgcaaaggacatgaactcatccttttttatggctgcatagaattccatggtgtatatgcaccacatttttttaatccactctaccattggtggacatttgggttggttccaagtctttgctattgacaacagtgctacagtaaacatacaagtgcacgtgtctttataatagaatgatttataatcctttgggtatatacctagtaatgagattgctgggtcaaatggtgtttctagttctagatccttgaggaattgccacactggattccacaacggttgaactaatttacactctcaccaacagtgtaaaagtgttcctatttctccacatcctctccagcatctgttgtttcctcactttttaatgatcatcattctaactggcatgaaatggtatctcattgtggttttgatttgcatttctctcatgaccagtgatgataagcatttttgcatgtctgttggctgcataaattttgtcttttgagaagtgtctgttcatatcctttgcccattttttgatgggattgtttttttttcttgtaaatttgtttaagttctttgtagattctagatattagccctttgtcagatgagtagattgcaaaatttttctcccattctgtaggctgcctgttcgctctaatggtagcttcttttgctgtgcagaacctctttattttaattagatcccatttgtcaattttggcttttgttgccattgcttttggtgatttagtcatgaagtctttgcccatgcctatgtcctgaatggtattgcctaggttatcttctagggtttttatggttttaggtcttacatttaagcctttaatccatcttgaattaatttctgtataaggcgtaaggaagggatccagtttcagctttctgcatatggctagccagttctcccaacaccatttattaaataaagaatcctttcccaattgcttgtttttgtcatgtttgtcaaagatcagatggttgtaggtgtgtggtgttatttctgaggactctgttctgttccattggtctatatatctgttttggtaccagtaccatgctgtttttgttactgttgcctagtagtagtttgaagtcaggtaacgtgatgcacacagctttgttctttttgcttaggattgtcttggctatgcaggttcttttttggttccatatgaaagttcaagtaattttttccagttcagtgaagaaagtcaatggtagcttgatggggatagcattgaatctataaattactttgggcagtatggccattttcatgatattgattcttcctatccatgagcatggaatgtttttccatttgtttgtgtcctctcttatttccttgagcagtggtttgtagttctctttgaacaggtccttcacatcccctgtaagttggattcctaggtattttattctctttgtagcaattgtgaatgggagttcactcatgatttggctctgtgtttgtctgttattggtgtataggaatgctagtgatttttgcacatcgattttgtatcctgagactttgctgaagttgcttatcagcttaaggagattttgggctgagacgatggggttttctaaatatacaatcttgtcatctgcaaacagagacaatttgacttccttttttcctaattgaatatcttttatttctttctcttgcctgattgccctagccagaacttccaatactatgtggaataggagtggtgagagagggcatccttgtcttgtgccggttttcaaagggaatgcttctagtttttgcccacttagtatgatattggctgtgggtttgtcataaatagatcttattatttttagaaatgttccatcaatacctagtatattgagcgtttttggcatgaagctaaatatcttttctgtatcaatttaaataatcacgtggtttttgtctttggttctgtttatgtgatggattatgtttattgatttgcttatgttgagccatccttgcctcccagggatgaagccaacttgatcatggtggataagctttttgatatgctgctggatttggtttgccagtattttattgaggatttttgcattgatgttcactaagggtactgtcctataattttctattttgctgtgtctctgcaggttttggtatcaggatgatgctgacctcataagatgagttagggaggattccctttttttctattgtttggaatagtttcagaaggaatggtaccagctcctctttgtacctctagtagaatttggctgtgagtccgtctggtcctggacttcttttggtttgtaggctatgaattgctgccccaatttctgagcttgttattggtctattcagggatttgacttcttcctggtttagtcttgggagggtgtatgtgtcctggaacttatccatttcttctagatttcctagcttattggcgtagaggtgtttatagtattctctgatgttagcttgtatttctgtgggatcggtggtgatatcccctttatcattttttattgtgtctatttgattcttctctcttttcttctttattagtctgactagcagtctatctattttgttgatcttttcaaaaaactagctccttgattcattgattttttgaagggttttttatgtctctatctccatcagttctgctctggtgttagttatttcttgtcttctgctagcttttgaatgtgtttgctcttgtttcttttgttcttttagttgtgatgttagggtgttgattttagatctttctttctttctcttgtgagcatttggagctataaatttccctctacacactgctttaaatgtgtcccagagattctggtacattgtgcctttgttccccttggttttaaagaacatctttatttctgccctcatttcattatttacccagtagtcattcaggagctggttgttccgtttccatgtagttgtgcagttttgagtgagtttctcaatcctgagttataatttgatttcactgtggtctgagagactgttatgattttcattcttttgcctttgctgaggagtgttttacttccaattatgtggtcaattttagaataagtgtgatgtggtgctgagaagaatgtgtattctgttgatttgtggtggagagttctgtagatgtcttttaggtccacttggtccagagctgagttcacatcctggatatccttgttaatttctgtctcattgatctgtctattgttgacagcggggtgttaaagtctctcactactattgtgtgagagtctaagtctctttgtaggtctctgagaacttgctctatcaatctgggtgctcctgttttgggtgcatatatatttaggatagttagctcttcttgttgcatttatccctttaccactatataatgctcctctttgtctgttttgatctttgttgatttaaagtctgttttatcagagactaggattgcaacctctgcttttttttaatttccatttgcttcgtaaatattcctccatccctttattttgagcctatgtttgtctttgcacatgagatgggtctcctgaatacagcacacagatgggtcttgactctttaaccaattcttcagcctgtgtcttttaatttgcccatttagctgatttacatttaaggttaatattgttatgtgtcaatttgatcctgtcattatgatgctagctggttattttgccaattagttgatgcagtttcttcatagcgtcgatggtctttacaatttggtatgtttttgcagtggctggcactcgttgttcctttccatgtttagtacttccttccagagcttttgtaaggcaggcctggtggtgacaatatctcagcatttgcttgtctgaaaggattttatttctctttcacttatgaagcttactgtggctggatatgaaattctgggttgaaaattcttttctttaagaatgttgaatactggtccccactctcttctggcttttagggtttctgctgagagatctgctgttagtgtgatgggttccccttgtgggtaacctgacctttctctctaaggtctggctgccattaacatttttttcttcatttcaaccttggtgaatctgatgattatgtatctggggttgctcttcttgaggaaaatgtttgtgttgttcgctgtatttcctgaatttgaatgttgacctgtctttctagattggggaagttctcccggataatatccttaagagtgtttccaacttggttccattctccccgtcactttcaggtgcaccaatcaaacgtagatttggcctttccatatagtcccatatttcttggaggctgtgttcatttcttttcactcttttttctctaatcttgtctttttgctttatttcattgagttgatctttgatctctggtatcatttcttccacttgatcgatttggcaattgatacttttgtatgcttcaagaagttcttgtgctatgtttttcagctccatcaggtcatttatgttcttctctaaactggttattctagttagcaattcatctaaccttttttcaaggttcctagcttccttggattgggttagaacatgctcctttagctcaaaggagtttgttattacccaccttctgaagcctgcttctgtcaattcatcaaactcattctccatccagttttgttctcttactggcaaaacgttgtgcctttggaggaggagaggtgttctgcgttttgaaattttcaacctttttgtgctggtttttcctcatcttcgtggatttatctacctttggtctttgatgttggtgactttcaaatggggtttctgtgtgtagatcctttttgttgatgttgatgctattcctttctgtttgttaattttccttctaacagtccgactcgtctgctgcaggtctgctggagtttgctggaggtccactccagaccctgtttgcctgggtatcaccagtggaggttgcagaacagcaaagattgctgcctgttccttcctctggaagcttcgtcctggaggccacctgccagatgccagtgagagctctcctgtatagatgtctgtcggcctctactgggggatgtcttccagtcaggatacacgggggttagggacccacctgaggaggcagcctgtcccttatcagagctcaaacactgttctgggagatcagatgctcttttaagagctgtcatgcagggacgtttaagtctcctgaagctgtgcccacagctgttccttcccccaagtgctctgtcccaaggagaagggggttttatctatatgtccctgacttgggcggctgcctttttttcagagatgacctgccaagagaggaaatatctagagaggcagcctggccacagcagccttgctgagctgtggtgggctctgcccagttcaaacttccatgtggctttgtttacatggtgagggtaaaactgtctactcaagcctcagcaatggtggacgctcctccccccaccaagcttgagcatcccaggtggatttcagactgctaacagtgagaatttcaagccagtggatcttagcttgctctgctccatgggagtgggacccaccaagccaggcaccagagggaatctcctgatctgccagttgtgaagaccatgcgaaaagcacagaatctgggccggagtgcactgttgttccgggtacagtctctcacagctccctttggctaggaaagggaaatcccctgaccccttgcatttcccgggtgaggcaatgccccattctgctttggctcaccctgcatgggctgcattcactgtccaaccagtcccaatgagatgaactggatacctctgttggaaatgcagaaatcacctgccttctgcatcaatctcgctgggaactgcagacaagagctgttcctattcagccaccttgccagcaagtcccctggttcttgttttttcattcattcagccactccatgtcttttgatgggagagtttagtccattgatattcagtgttattattgataagtaaagactcaccctgccattttgttatttgttttctggttgtttcttggtgttctcttctttctttctctcctttctgtcttcctttagtgaaggtgattttctcttctgatataattaagtttcttgtttcttattttttgtgtatccattgtatttttttgtttgaagttatcatgaggcttgcaaatactatgtaatatccaatcgctttaagctgataatagcttaatgttgtttgcatcaacaaataaacaattaaaaaaactaataaaaactttacaccttaacttcattcccttgctttttagcttattgttgcctctatttacatcttattgtattgtctatgtcttgaaaagttgtcatagtcattattttttattgattcatcatttagtctttctatttagcaagagtagtatacacaccacagttatggtgttataatattgtgtgtgtttctgtttacttactatgaccagtgagatatgtaccttcaggtgattacttattgttcattaacatccttttctttctgattgaagtactccctttagcatttcttgtgggacatgtctggtgttgaaatcactcatcttttgtttttctggaaaaatctttatttctccttcatacttaaaggatatttttactggataggctattctaggataaaagtttttttttccttcagtactttgaatatgtcatgtcaatctctcctggcatgtcaggtttccactgaaaaatctgctgcaagatttattggagctccactgtattaaatatgttatctgtttattttctcttgctgcctttaggattctttcttcatcctttgtatttgggagtttgactattaaatgcctgaggtagtcttctttgagttaaatctgcttggtgttgtataaccttcttctgcttagatattaatacctttctcttggtttcagaagttctatgatattatccctttgaatcaattttctaccccctatctctttctctgcctcctccttaaagtcaataactctcagatttgcccttttggggctgttttctagatcctgaggatgtgctttttggttatttattctttttttcctttgtctcctcttactgtataattttgaataccctgtcctcaaattcactaattgtttcttctggttgatcagttctgctattaaaagactttgatatgttcttcagtataccaattgcatttctcagcttcagaatttatgctggaaaccttttaattacttcagtctgttaaatttatctgatagaattctgaattccttctctgtgttatcttaaatttctttggcttcctcaacacagctactattttgaattctctgtcctaaagttcacatatagatatgtttctccaggattggtccctgattccttatttagttcatttggggaggtcatgttttcctgggtgctgttgatgctaatagatgttatttagtgtctgggcattgaagagtttggtatttattgttgtcttcattgtctgggcttgtttgcacccatccttctttggaaggctttccagatattcaaaagtacttgggtgctgtgttccaagctgtatctgttttgggatgcttccaaagcccactaacactttggttcctgaaaactagtaaaagtacctccttgatgaccttgggcaagaactgggagaatattctgtgctaccaggcagagacacttgttttcttcccttactttctcctaaacaaaagtagtctctctctctctctctttctctctctctctctctctctctctctctgttttgcatcacttgaagctggggatggagcgaaataagcattcttgtggccactgccactataactgagctgggtcagacttgtagccagcacagcactgggtctctcccaaagcttgcaataaccactcccttgctactgcctatgttcatttaaggccctagggttctacagtcagcagatggcaaggccagccagacctgtgtccttccctgcagggtgaagacttcccccaggcactgggtgaatccagaggtgctatctgggagtcagggactagattcaaaaaccatggaagcctacctggtattctattatactgtgactgaactggcactcaaaccataagatgcagtccttcccactcttccctctccttttcaaaggcagaggagcctctcctggtagctaccaccatcccaggccatggggagttctgccagactaccactgatgttctcttaaggcccacgggctcttcagtcagcttgtgatgaatgctgcctggcctgagactcacccttcagggcagtgggctcccctctgacccagggcaagtccagagatgctgactaagagtcaagtcctgaaatcagggatcccaggggactgcttgatgcactatccccccgtggccatgctggtaactaaggtgcaagacaaaattccctttacttttccatctgcttttctcaagcagaaggagttttgcactgtatccaccagagctggtcatatgctgaatctcacctgaaggcagaaagtctcagaggctcacccaaggccttgacgtagtaccaggtaatcgttactggttgtttagggacaaagggcttttcagttagtgggtaatgaatgctgacagactgagtctgtctttttttttttttttttttttttttgagacagagtctcgctctgtcgccaaggctggagtgcagtggcgcgatctcgcctcactgcaagctcccccttccgggttcacgccattctcctgcctcagcctcccgagtagctgggactacaggcgcccgccaccatgcctggctaattttttgtatttttagcagagacggggtttcaccttgttagccaggatggtctcaatctcctgacctcgtgatccgcccgcctcggcctcccaaaatgctgggattacaggcgtgagtcaccgcacgcggccctgagtccttccttttaaggcagcaggttcccttctggctcaaggtatgtctggaaatgttatctgggaactagggcctgaaacagtgacctcacaactctggtgccctttcctgctgtgactgagctggtatccaagatacaagacaaagtcctcctcattctttcctctcctctcctcatgcggaaagaagaggtctcttttaagactgccagctatgcagcctggggttaggggagggctgatgccaatattcccttgactgctccagctggtgtctcagtaggttgcaagctacccagtccactgtctctgggctcaattcagccctgggacttgcctaagagttgcaatccttatgtcatagactgtctttcaagtttacttgcagacataggttgctggagccctccgtgatgaggtttgcaggaaatcaagtcttgaccactaggatccacaattcccctctgactagggctggtttaaatgctccctctgtggacaggcatcagctgagtttggttcagttctcctttctgctataacggaatagcactgagttcagtgcctcactgttgctgtactcttcctcctgcagtgtggagttgctccctgcactgtgcagcttctgctggggtagtggcagaggggtagtattagcgattcgagactgcttttactatctcttcagcgcctctttcagcaatacagagttaaaaccaggtactgtgacagctcacctgatttttgcttcttatgaagatgtttttttttttctgtgtagatagttgttaaattactgtccttgcggggaagataattgatggagcttcccattctgccatcttactctgcctctttgtgagttagtttttaagataaggtgtaagttaaggtcaaggttcatcgttgcctatgggtatccagttgttctagtatcatttattgaaaagactacccttcattgatttgtgtttgcacctttaccaaaagtcagttgcctatgcacctattcttctgccaaaccacactgctttgattactgtggctatagtaaaccttaacatgatatgaagtgattcttcctgctttgttcttctttttgaaattgctttagctattctagaacctgtgcattttcatagaaattttagaatatgtctatgtttatgtctatgtctacaaaagcttgaaattttaataagaattacattaaatctatagaccaattcagagagaattgacatcttttatatactgagtttttcattctgtgagcgtgatatgtctctccatttctttttttatgttcttcatcagtagtttataattttaagcatatagaacttgtacatattttaagtatatacctaaatattttattttctttctaacaattgtaaatgatattgtgcttttaattttattttccacctgttcatagtatatagaagtgaaattaacttttgtatgttgatttcgtatcttccaaacttactgaacacacttattagttctagaggtttttttatagacttcaatggattttctatgtaaacaatcatatcatctgcaaatagggacaattttattcctttccttccaactgcataccttttatttctttttcttgtcttattgtgctgactaaaacttcccgcacagtgttaagaaagagtggtgagagcacacatctttcccagttttagggggaaagcattcagtctttcaccatttaatatgatgttaacaataggattttttacatgttctttatcaagttgaagtaatttctctctattgctaactggctcagagtttttatcatcaatatctgtggaattttgtcaaatgtgccttccatatatgttaatatgatcacgatttttcttctttcacctgttgataaatattgcacctactatgtacccacaaacaattaaaaataaaaaaattaaaatgatggattactttaattgagccaaatgttcaaccagtcttgcatacctggaataaatcacactttgtcattgtatgtaatttcttttatacattgttggattaggtttgccaaagttttatcaaaaatttctacttctaagttcttgatagatattggtctgtatttttcttattttatactatctttgtctggttttggtagcagggtaatactggccttgtaaaattaggaaatgttatatctttgaatttttggaaggcatcatgtagaatttattttaattatgttttaagtgtttagtagcagggattattcatcgtggttgagattttagagtgtgtgatttttaggaaactggtccatttcttataactggtaaaatttatgagtgtaaagttattcatattcctcccttattaccctttcattaactgcaagatctgtagtgctatctcctgtttcattccccatattggttacttgtgcaatctgtttttgtttttgtcagccttgctagaggtttatcaagcttataatttgtttgagaatcagcttttaattgtatcaattttctccaatgtttttctgttttcgacttcattgatttctccctttctctgtattatttcataatctttctgcatgctttgtgtttgtcttttttcttttttctagcttgttgaaagtattagaatattaatttgagacttgcttcttgtttaatgtaatgatttcatgctatgaacttctctctgagcactgctttagctgtatctcctatattttgatatgtttgttttattgttattttccttagagactttctctttgactgatgggctatataaaggtgttttgtttaattttgaagtatttggatattttcctgttttgttttattattgatttctaatttgatttcattattgtcagagaacatatctgtatcatttcaattattttatatgtattgaggtgtcttatgatgctgggtatggtatatcttgatgaatgttcaatgaatgcttaaaaatgtgtgttctgctgttctcatgtggagtgttatatctatataaattagatcctgttggtttattgtattgttcagctcctttatatctttgatgactttctatctagtagttctatcagttgctatgaagaatatgtgaaagtccccaactatacagatccacaagtatagctggggacttcaacatactatttctccctttgggtctatcagattttgcttcatgcatttgcttcatttatttgttttggggcactattgtttaatccatgcacatttaggatcattatgtcttcagggtgaattgatccttttatcattatttaaagtccctctatctctagtaatttatttgccctgaagttgattggatactatgtattaattcctacctttttaaaattagtatttacttggtgtgtctttttccattcttttatgtttaacctacccctgttactgaagttgacaagtgtttcttgcaaacagtatatcattgggtaatgtttgtttgtttccttccagtctctgtcttttgattcctgtatttagactgtttacatttaaggttattattgatatgttagaacttaagtctgccattttattatttgttttccgtttgtttcctctggctctcattcctctatttctcttttcttgccttcctgttggttacttgaacatattttagaattctatcttgagtcatttatagtgtttttgtttttgagtgcatattttgtatagttttcatagaggttgctgtaggtattacaatacacatatgtgacttatcacagtctcctggtttcaacattttaccacttttagtatagtggggaaaccatacttacattaaggtccctttacctttcccactttttaaatactattgcctttaacatcagataatgctattttttgtttcaatcatcaactataatttataaactataaactcacaaggaaaaagggaatttattgcacttacccacatttatttttaacagctttagtaagaaatcatacagataccatataattcactcatttaaagtgtaaaattcgatgtttttagtataacagggttatgcaacattcaccctgccttagtttatttctgttgctataacaaaatacctgagactgagtacattatcaagacaagaaatttacttagctcacagttctggaggctggaaaattcaagatcaggtggctgcatctggtgagagccttgtgctgcttcatagtttagcagaaaagtggaaggggaattggttatgtgctaagagagaggagacaaaggaggctgacccgttttataacacaacctgtttttgcaggaactgattcagtttcatgaggactaacccagtctcctgagaaagagggtaatccatcttaatgacctaatcaccacttaaaggccccacctctcaacatggttacaatggcattaaatttcaacatgagttatggcagggagaaaacacatccaaaacatagcacactacaattatttttagaatattgttccctctagaaataaatcccatatccattagcagttactcttcattcccccaaattctccctccctgccagccccaggcaaccaccaagatattttttgtctctattgatttgcctgatctggatatttcacatatatgaaataaaatcatttgtagtcactttgttactgggttctttcacttagtataatgtttttgaggtagcatgtatcactatcttattcctttctactgctgaaaaatattcagttgtactgatacactaccttttacttacccatttatccattggtggacatttgggttctttctacttggctataataaataatgcctatacaaacatctgtgtataagtttttatgtgcatgtaagcttttatttctatttgttatgaatctaggagtggaattactgagtcatatcaaatcctttccccatttataaattgggttgtttgtctttttcttattgagatgtgagagttctttatatattctggataaaattcccttgttgtacatattacttgtaaatattttcacattatatgggttgtcttttaactttactgatgatattgcttgcagcacaaaatatttaaaatcgatgaagtccaatttatctgtttttcttttattgagtgtgctcttggtgtcatatttaagaaaccataggctaactcaaagtcatgaagacttactcttatgttttattataagagttttattgttttcactcttacatttaggtctgtcatctattttgagttgattttttgtgtgtatgatgtgaagaagttcactcaatttcatttgtttgtatgctggttttcactcttccagtgtcatttgttgaaaagactattttttgctctatggaattctctttgaacttttgttgaaaatcaggtgaccacaaatgtaattgtgtctttgtggattctgagttctattccattgatccacaagtctcgccctatgccactatctgtcttaatgatgctttgtaatgagttttgaaactgagaattctgagtccttcaactttatttttattttccaagggtactttgactggtctgtgtccctttaatttaatttccacataaatgtatcgatgtgttaaactgcagatacattgggggagggagttggggagaatgtgaagtgactaccaatgggcaagggatttctttagtgggtggtttaaatgttctaaaatctattgtggtgatggttgcacaattctggatatacacaaaaacatactgaactgtacactttaaatgagttcagtgtatggcatgtaaattatatctcaataaagcttattaatgaaataaatctaataatgaaatgtgaagctctcatcacaaatttaaaataattaagtaattaaagaagccaaatattatatccaaaactcattggaacactcaagttcaatatgaaatcaaatgatagtgtccaaactcatcatgaagggcctaaactggctataatcgatgtttgtaaccaaaattgagaaatggcagtacagtacatagcatgatttctaacagaccaaaattcagtagtcagctatgtttaaattagaaaagttttgtaatattcataaccactgttttctagtgtcactctttttttgctagatctaaatgtattcatagtttcatcattaataaattcgttcatttattgtactcctggaaaacaaacaagtatttttatgctcattataataaaaacataatggaaattcaatttactaaaaacctaaacctcttcatatttaaaaatttatttgaaacattgaagtaattgctaacaaaaacctaaagaagctatcaagttaaaaagataactttttatacttctattttaagtttaggggtacaggtgcaggtttgttacataggcaaatgtgtgtcatggaggtttgttgaagagattattttatcacacgggtattaagcctagtacccattagttatttttcctgatcctctccctcctcccacccttcaccctctaataggtcccagtgtgtgttgttcccctcttgtatgcccatgtgttctcatcatttagctcccacgtataagtgagaacatgtggtatttggttttctgttcctgggttagttttctaagcataatggcctccagctccatacatgtccctgcaaaggacattatttcattcttttttatggctgcatagtagtccatggtgtatttgtgccacattttctttatcccatctatgattgatgaacatctaggttgattccatgtctttgctgttgtgaatagtgctgcaattaacaaatgtttgcaggtgtctttataatagaatgatttacattcctttggttatatacacagtaataggattgctgggtcgaatggtacttccgtctttagtaggtctttgaggaattgtcacactgtcttccacaatggttgaactaatttatactctcataaacactgtataagcgttcctttttctccacaacctcacagcatctgttattttttttgatttcgtaataattgttattctgactggtgtgacatggtatctcattgtggttttgatttgcatttctctaatgataggtgatgttgagctttttttaatgtgattgttggccactatatttcttcttttgagaattgtctgttcatgtcctttgcccactttttaatggtgttgttttatttcttctaaatttatttaagttccttgcagatgctggatattagacctttgtcagatgcatagtttgcaattttttcccattctgtaggttgtctgtctactctattggtggtgtttgtttgtttatttgttttgttgtgtggaagctctttagtttaattaaatcccacttgtcaatttttgcttttgttgggattgcttttggtgtctttgttgtaaaatctttgcctgttcctatttcaaggatgtcattgcctatgttgtcttttagggtttttgtagtcttgggtattacatttaagtctttatccatcttgagttaatttttctatatgatataaggaaggggtccagtttcagtcttctgagtatcgctagcaagttatcccagcaccatttattgaacacggaatcctttccctattgattgttcttgtcaggtttgtcaaagatcagatatttttagttgtgcagtcttatttctgggttctgtattctattccattggtctatgccagtaccatgctgtttggttatttagccctgtagtatagtttgaagtcgggtagcatgatgcctccagctttgttctttttgcttaggattgccttggctattgggtgttttttggttccatatgaattttaaaatagttttgttctagttctgtgaagaatgtgaattgtaatttaatgggaatagcattgaatctacaaattgctttggacagtatggccattttaacgatagtgattcttcctttccatgatcatggggtgtttttccatttgttcgtttcatctctgatttctttgagcagtggtttgtagttctccttgtaaagatctttcacctccccagtttgctctagtcctaggtattttgttgtttttgtggcaactgtaaatgaaagtttattcatgacaggtcttggcttgactgttgttggtgtataataatgctagcgatttttgcacattgattttgcatcctgagactttgctgaagttgcttatcagtttaagtagctttttggctgagatgatggggtttttgagagatagaatcatgtcacctgcaaacaaggatagtttgacttcctctcttcctatttgaatgccctttatttctttctcttgcctgattgccttggccagaacttctaatactatgttgaataggagtggtgagatggggcatctttgtcttgtgccagttttcaaggggaataattccagcttttgtccattcagtgtgatgtaggctgtgagtttgtcatatatgtttcttattctttgaggtaagttcattcaatacttagcttattgagagtttttaacacgaagggataaagataattttaatttttcatatgtcagtgaaattatgtgacatacacatgatggtacatatgccatatattcgccagtcttgtcaacattttaagcaaggaggctaaattattccacagatcagctgaatgattcatatctgcccttgtttgcctaaaatggaagctgcaaggtcatattttctattcatcctggatactcataaagtccttttcaatccccacacaggtcctttgcaggggttcacctgactatactcaatgcagtgttccacttctctgtagtcaagaaagaaaaacgaaatgtcatccattcaccactgcctaagaaagacatagcctaaatggacagcaaatgtccagttatataaaaaacccacacagctgcactgagccctgggaataatgccagtattgctaatagagcaatgcttctcaatgtgtggatacactaccattggtggtccacaagaaaatttgcggggacacactggcaaatgttttaatagttatgtatttgttttcttgtgtactaagaaaaataaatacttagcacacaaaatctgtgttctcaaaaatattactttttgaggatgggtaaaaattatggtattattagtaattcctttacttagaatgctcatccatctctcttgtttgtctttgcctcatgagtaagttcttccctgacccaactttcagacagttttagttggttctccctctggtccccataatgtttttcacatatctcatttatatcacatttcagattacagtgtaatttttataagcacacttatttttattagagtgtgagcttctcaagaatcagagtcaaatctttgtatccttagagcctgatacagaggttggacccttgtagtgctcaattaatatttgtggaattaatgcatatgaattacaactgtggtcaggataattacgttctacaagcattgatctagtagctatttctcagttggaggcacgatggcagggtatctcagggagaactgaaaatttaaaactacaagacaggaaaccaagcataattaattctctatttgattaattacattagcaaaattttatatgctgagttttcttataataatagatttctgatctaagattcaaaagcagaattactgaaaagaaataaaggttgaaagaactgaagtttaattaagagagcagaggctctggaatcaaactgttctgagtttgaattcttactcaacaattactagctttatcatctgtatactgaggaccagagataattcatatgaagcctaacaaagtactttatacatggtaagatcctgataagtgcaagctgttattattaatttaaagcatatcttactaattacatacaactagtaattctgtgaggtctagcctaagagaaaaatataaagaagtccagttctcccctcttactttgttaccattcttactccaaccctctctcatgatagcattatgatcattaccttccagacttatgccaaccaccagtttaaagcacacctggtctctctctccaaagttcctggtataaatcttccctatacaaggaaataaatcattttctaattcatactttcctggtggcaaggagataattgtttaaatttaaaaagttttttcatctaatttctactgggttagagtaaatcagaatgctgtcaagccaggaaagtacttaattaagtagagaaggtgacaatgagtcagcgtactttgttggaaaaattacaggccaaaagtttaagtaggagaccagatttctagtctctactttgctaataactcacttagaaactttaggtgagttgtttaactgctctagcctcaacttcgttacctgaagatggtaagttctatgccgccaagacactggcttatattttcaaaaaaataaggctgtatcccccactcactcctgaaaccaaaataaattccagaggactgaacaaatatttaactataaaatgtcaaactatataatttataaagagaagtgtaaatggatttgtttatacctgtggaatagagaaactcttctaaaggaaaacacaaccagaagtaataaaggaaaataataagactacataaaagcttaagtcttctctctagaaaaaaatatcactattaagagctgaaagaatgaaagagaaaatccagtagaaaaagaaaggatatggtcgaaaaattcacagacaggaaatacaaatggtcatcaaacatatgaaaaaatgttcagcttcactcgtaattaaagatatgcaaatcaaaaaaagccatttcaatctattcaatttttaaaaatgaataatttttcaggtaccaaatgctgtaatgtcaaagtgagcatgcttctgtgtcagagtataaattggtgctgctctccagtgccagttcttgccacctgtctctgaagtacttctttcccaatcattctcagagatgaccctcttccactattcctattttctgatttggcgtcccacagccactttatagtctgggacactatgtgcaaataggtacttttttccatcacacatcatgtcacctcctctgctttctggaaagttcaaagttccttcaatatggctctttttctctctcctactctttggagtctcttctctaataaataagttctacaaatttcaagaacctagccagtgtaattttcaaatggtcattagcagttggctgcctggaagaaacgaagacttgagtaagctcttaaaatgtaaacaaagcaaaaattaatattcaagacattaatcttaccacagttattttaaagatgaaattaagataaccaaatacaatagaatgctacatttattgacaaaaattagcataaactcacaaaacaatgtttctgttttcaagagctatacaaatattaatatttttcacagagcaaaacccatctcacaaaccaaaaaagcatgaaccatatatattttattaccttttttatctccagtgtgggccttattcagaagaaattaagtgctaaatggtatccaatcttacaataaatttagaagtaaactagaacataaaaacaaataggaaactgaaggagtaattatattttcccttaaacatgaattgatcatgtgtctgtatatgaagtagactaaacaatatatatattccaacaagtaaactatttagagagcatatttttaaaaatattatcttatttccacttaggcaatttaaccctgaaaccaagggaaggagttccaaagatatgcttagtttattggaaataatgaaaatatgtaaatgtggatttatactatcgtcattaaaatttgtgagaattgagcatgtccatttgcttgaattgttactcatttcaatataaaatataatctttttaggttttgagtaggtgtaaatgattgaagcatgtcagctattgtttaacaaaggaagtgagcatagactgaataaaaaacggatagaaataaacaaacaaaaaagaatgattccttgaaaaacaagtaaatgtgagaatgtcaccatgtccttagaaggtaagaacacacacacacagacagacacacacacacacatatatatgatgcctccaaatatgactcttaagacataaattttaacgattcctccttagtgaatctccctttctttcttccttcctgtactctagctttgctgtgcattctagagcattttaaaatttaatacctttgttgaagagccatttgtccttttatcctcttaaaggactatacagttaatgttagcaatagcaaagattgccaattccccatacaagaaaatctacttgagctctgctacttcatcagagtgttcatatctacactttgaggattaaagacaactagttttaacatcattttatctcaccttaaatgtgtctaagttaaagcaagctccagttgatggcccatgtgtttcaaataatttacaacaaaacgaaacaattcgtaggttatatgaagcttgttataaaatgataagtaaggctctaagtgaatggataaagcccaaaacaggaaaaggaaaaaaaaaatcctagcataacacaaactgaagaaaatcaattgttacagacatctaaaaaatcgcatttaactttagcttttggttaaaatgccatcagtttactaaattgaatatttttcttaataaagatgttggtttctaacacacaacctatttgacaggtcaccactattctctcatgaagggtgattatttctaatcaaccctcactagtgaacagttggactacaccgaaaactgatctattcttgaaaataggctcttgtctcatataggcagcctggggcatttatcagttcttgaattcttgtttcatttctttttgtaagagtaaccagcattagtgaactttctaaggagaaaaagcctgaacattaaggccaattaaaataaacaaagtgaaaatataattgctttaaactaaagatgtcattttttcaatgtgccacaatagccgcaaaactttagaagtgtcacaatctacatttccatattttaaaagctatgaattaatatctgtgcttctataagttgaggatgaaggttaaacgttcctatcatattaagattttaaaagtctatttcatgcaaaaaaacatagatatcaactataccaaaagtataaattaagttcaatagataggatttagtaaataccctagaaattttctaagagagtagatattaggtgctcttaccacaaaacaataatttttttgttgttgaatatgttgacttgcttgaccgtagtaatcatttcattatatgtatatcaaaacatcatgttgtacatcttaatatatacaattaatcttttaattttaaacaataactatgtatataaataaatttaagggaagctgaaatcttataaagtaagaaagtttgaaactcttttcaagtaaatgatgacacctactggatgttagaaatcttcaaataacatttaaccaataatgaatctcatccgcaatttttatctgaaaacctctttgctggcaagggaaagaagaaaacatgggcaagcatttggacgttcaagattaaaaactcacattcaccagacttactttagaccaaaaaacaaataaaggaataaggtaaaaagtagtttttctcttctgaattttctactttcttgaggtatagaaaactgactagagaatacaagtttaagatcatagatgagtgaggatccaatgaatcagtaaaaagatatatctgaagtaggttgacagccagagtttcatcttgagttttaaggtcattgagatggaacataattcgtgtttaccaaatgtgtcatttagtcattaacatttctgtataaactgtgtaattgctgatatcacaaccgtagataaaatttttagtaaaaaagtgaaaaaaactgcctgattttttttttttttttttttttttgagactgcgtcttgctctgtcacccaggctggagtgcagtggcatgatctcggctcattgcaacctctgcctcccaggttcaagcgattctcctgccgcagcctcccaagtagctgagattacaggcatccaccaccacaccccgctaatttttgtatttttggtagagatggggtttcaccatgttggccatgttgatctcgaactcttcacctcaggtgatccacccgcctcagcgtcccaaagagctgggattacagacgcgagccaccacacccagccaactgcttaaattttaatagatgatctttcgcaagtcatttaagctctctgggcttgtgtttattcatctgtattccaagggtattgaaactagaaaatctctattagtatctgctaaacttgaatgtctgaaagcctaaaaatagcattcttttaaattgttactttaaaagtcggtagaaattttacaaatagaaacataaaatgtattatattccttttacccctagaaagcagctcaatttacttttaccactggaaaaataatctatctgtcatatcagtggctactctttaattcagtattttattagtctttggcctgctgcaaataaacataggacataggaagatttgggtcaccagaattacagtttttccagagtcagtctcagctaagtggcatcatcaattcaaataaatttctgatatcaatcttaaacaaggctcagaaataagtgtattgatgtatttggctcactgtagacttggatttattttaccctctgaaaataccaacaaaaaaaatctaaaacactgtattctaataatatgatagaattcttgcattatttgctgacaatagtatatagttttccaattttttattttattaaaatacaacaggaataataatggtgttgcatgaggtcaaaattagagatattttaacagagaaaataaagtatttcttactagtcaatcagtatttttgagatcccattgcatgcaaagtagtgtatctagaatgcttttaattaatcatatatatatataattttaaactatgaatatacagaacatttgaagacctgttttatcttggctgtttagcattccttttctcataaatacataatattttcttttggattctctgtcaatatatcttaatgttggtgcctttaatccataaattttcatatcttcctgtgtcatttttaactggttactaaatggacacgttacagttcctgtaaattttgggagtggtagtaggcatgcttaatagccaggtaaaattagggaattctgtggagaattgtcaggcaatcaattttcctagtcattaataaattaaaaagagaaacaagccaacgtaatcttagaaaaaaatagtccagtaaaaagtctcactttgacaattacacaaaaataacctttttactctggaataatttatcaattttagaaaaatatattggaaaagtagtaaattctacagaaggtatgtagagtgtgatgtgctgagtaaatatttaggcaaaaggaaataagtatatacaagtttgacccaatttgaagaagtttgatggagtggttgggaaaaaaaggaaaaatcaagcttgcttgtgtcctatgagtagtacaatctaaattgtatagtataacagcagggaagaatttcttagggctaaaataattgaagaaggcttttgtcaaagaggtgatatttggattgggtctaaacagtttggtaaacatttgataggtgaagatatttgagaatggggctgcagtcagaggtaataatactgcaaaggcaaagagcctaaacaggtttgctaatgtaaaggaccgctctggttaatggttagaaggaagaacatgaggaaatgggggattggggtcaagaaacagaagaatgtttcacacttagaaaatgttcttttgcatgcatgactattttttcaatttaataagatataaatcacagttgcaacacgttagccttcaagaagaaaaaactggccaaaaaagaaaattgctgacaaatttaagaggagttttagagctcactgacctgcacattatgctttgcttctctaagctttaccttccaaggctcctcaagataatttgtttcaatccacttggactaggcactatgttccctgaacaagtacaaccttttcctgccgctgcatttgctgtaatgtaacagtctaccgaactgttcacaggcaagccaaattccacttcctcaatcaaaccctttgccaagttaccttagtcctaaaagatccttccctcctgttttattattgaatttagattgcaccattcagataatacaatcagctttgatttgtaaataggtatgcatctgtttgctcaatcctacaaaattataaaattccttaaagacagaagctgtgtaatgcaactttgcatgctacagggtttcgcattttcataagctagtctacaaaaacaaaatccgactcacaaaataatgctaaataagaatttgttgaatggatgcattccactgctgacacattttcattcccttcatttttcttcttatccttatgaggcaatccttatattaaaatcaatttttatgcttatcttctaactgttggagaataaaatgattgaaacatatttaagttcacccaggaatgcttttaccataagggcaaaaagtgacatcaggaacatctagggattatcccaataactgtggacgaaggaagcaatttaaatatctttctgatttacttacttgaattagaatgcagtatgaagttgggggaaggaaactgagcagcagtcacgcaggctcattctacctgatctatgtaattccatactatcagtgctggggaagaatgggcaataataataataataatgatataaatatataacaaaataaaaataatatagcaatagtaaatataataattacaatgggttattctgttaggctgtatttttgcttgaagggatggtttggcactctgtagcagatacagtgtttatctcttaaactgattattccaaattttttaacctacataaacacaaatgaattcttcctaaagtaactgttcaaaaggttaaatttcttttttgattaaccctccaggataaggatttgggttgttgtttgggagcacttttatacacaggtagctcttacaacaaccacatcaaggcgcctctgagaaagggcggtggggaattagatcctctattttaatcatatttattcccaagtaatttattcatcaatctccacctcaaccctgaaaactttaggtctcagaaactgacactgaaaggcacctataagcctctcttacagtcgaaagtcacctaaatatggctgggactagagtgacgctatggagacattctcctttggcaaaaattttaaagggccgcctagaaactcagtaatgaagatacttaatatttttagacaatctttttaaatatcaaaattcttgcaaaaaagtccatgatgaacaaaatatcaaaaatttaaataaagacaggatcataccctgcacttgcgtgactcacctcactcgcctcatcctagtctcctgggtttttgtcacaagcttaaattttgtgcctgaggcgagtacctcaatggctttatgctagtctaggttctgagtcctaaacactttcgtggatagcaccttcttgagtcctttcactaaatgcaaccttcagattaaaaatctattctcagtgtttttcatttggatagacctctgctattacacatttccctcggagtcccgctgaattcttcgtatacctcctccaagtgggataacggtatagctcccggttttgtcgctactctacacctgcggaaaacacgccattttggcaccctcctcttgccagcaccacagttctgctttggcaggatgttcccacaccagagaaacatctccactcttttgcgctttctgaatgaatgttcttgtcggttcaacaccatcccgccaaaggtggcagggaaagaccggagcccagactcaactggtcttaaaagcacttatcccgctaggaatagggaagggtggcgggtttggaggctgtgaagaaagcaactgttgtggctttcgcctgtcattataacataaaagaaaaaaaaactgatcaagtcagctctggctttcctgctgttcttattcctgatcgcttagcccttgctaagttcgcgtgctccgccactacaccagcggttagagccgacagggaacgagggcttcgggcaagttcgcgggccacgcccctcaaagccggctgcctcttcttattggcctgagagcctgtcactccaatgtggctcccactccggttaaccattcacgtagtttggttgcgtcttggcgtgtttaatgttgccaataacgagggattttttttttttccagaggagagtacaggtcgtgctgcagttagttcattgaaaactcatttgctcttggagcagtcaggcagtgactgccttcggctttttttctgctgactaagatctcctatagagagctacaacaatgcccaaaagaaaggtaagtgaaatggaaagacagacggggaatgagctgctgagttacctatttcctaataggaagaatttatttgtttgtttggttttttttaaagctttttggcttcttccattttgtgatgtaatgaaacggaaaggggtagaagggcaaagagcagtcggtgtaaggtttaggatggtcttgcatgcaactggtagttcacttttggagtgttctgtttaaggagagaatctcttgaaaggtgtctccatgctgaattacaaacagccatagcgctgggctgtcgcttcctaccccaacccccttcctccgcttaccctattggagaacacttctcccaaccatacttcagtttcctcctctgccaccggcttttctcggggaaccgtcccgtctggggaacgaaagccatggctttctcctgtatttgcctttgttcttcccgttttcttttttcttttttttttttccttccctcctcctccacttcttgtcaggccagatggctatgcaatggtaatcctgtgccattaggcggcgcagacttcaaactgtcctagagaacagagattcaccgctgtaattagaaactttaggggtgagaaagctggacctttccaagctctttagctaaagatgggaagattataaggagacagcgtcggataaacttgctgatgttggggtagcatggatttgttcactttagtagtgcagaattgatctgagcctttcgagctccacaggtcttctgcaaaccctcacttcacaattcctggctcctcgcagacaggaaacaagttcacgctcggcgtttttttcttagtcccctagaagtgaaatcgaacgctgtttcattgcttggtaaaaccgtataacactatgctaagacattatgattgtttttggattattcctataaacaactccgccttccttattcctaaaacataggaataatactgaaattcccccgtgctctgtggctgtctgaatcgtgcaatagcttgataattctcaggctaaagggctgctcagatatggaaaacaactgtttctaatcaccatccccccttcctgagattcccgccactgtgcttttctatacttgtgcagtaggtcttgctgttttccagagctgacagcaaccttaaagcaggtagtggcgggaagttttaaaatcggcggccagtttcttagaataaagcattgactttgtaacaaagaggtctccccaagaaaacactgtgggggctgtaattcttgcatgcaaaacttggagaaaatagtccagaatcagtggagaggataagataggtacaattgcatggcaaacataaggcaagaaagcgaaattgcatgaagctccgccttcatttgacccacccccacatttttggcttttacattatctaaagcaggtggatttcaaaattacaaaggtttgcttttaggagatgcaatttacacaaaaggatgaaattaactatcaattgtgtaaaagtatgtcttgtgcatgcacttgcatcttggtgcacattagtaaaacagcagtatgtagcatggttcctaagaaacaacacgtgtctacttgagcaggaacccaggagaaagtaataagcaattatattgaaatttgtaatccgcaggcagtattttctgatttatgtgtttatatcaatgaccttatttctgtgtggttttctcctctgtgtaggctgcaggtcaaggtgatatgaggcaggaggtgagtttctttagtcttagcatctattaggaaaaaccactcgttttataaacttgacataagcagctaaaaaatagatgctggttggtatatttgtacaatatgagttccaatatggtataccagtgggatctctcaaaaatatatatccgaatttcagaagagaggactttttaaaattgccattcagaataaaagaaaaggctttttcacttttttttatagaaatgatggtacggaaatattcttgacaatagagatgtgctaatattttatttgggtgttttgtgggttagactatgatttggtgtgtgtactttacaggcttacatgttgcttactttagaaagttgaggctctaaatgactgttcacatatgtgaaacatttcttaaagtactatatagtttttgttattgcattaaatatatattgttctaactcctagagtatgccatcttctatatgtcctacaaagcgagaatcattgttgtgcgacaattatattaaagaaacctctcagtttacctttatggccttgttaatctaatattttggtcaatgcatattattaattttaatctaattaatgcacaataaaaatatactgagtgtgaaaaaaatgtatatatagtaagtattaaaaactgcaagcttcttcgaatttaagaccttattgtgcttgttcagatgtggagagaacttcttccttttaagcaaaataattgctttgtcatttggcaagaaaaggctatattttcatttctaaatgtgctccttgttactagctactgtgttaatttagcctagctgcttaagcttaatttgggactttttccttagtatgtaaagtgttcagaggacggaaaaatcaaaacttatatttctcttgtattttctaaccaaattcacaattacttaatgacaatatttatgtattgttacaccaaatattttgacctcaataaaaataattctagctttttgtatccataattctcttaacagatttttgtttttaacttatagccaaagagaagatctgccaggttgtctgctgtaagtaatcttttcaaaaagcagcccatgtattgtgaaacgtcattttaaaatttagggaatcctaaaatattcaatacacgatttatttttgaagttttaagaaaaactttcacaccaaggaaatgtattttttttcctaatactcatttattttaattcagaggttggatttcatttttagcgttctttcttcaaatatgatttttttccttttcttttcttttcccacaacttgaagcagatgcttgtgccagttacaccagaggtgaagcctaaaagaacatcaagttcaagggtaaatattcaacgtagaatattgaaataaatttgctttttttttcaaaaataatttttgaaatggcatacagctgatcattttactttgcttatattttgttcagttagtaatatattatattctatcatatgatacatgtaaaccccttgggtggggattatttgttctgttttgtgattgtccacagtgttttgacattttcactgggtagagacaaaacaatttcagttggataggcccattaaatgtacatgcctttgctatcatatagtgacaatactgtttccctgggaaaacaaaaggtgaaaacagtagtaaccccaaagttgtgctttgtaataaaagtagtaactaacatttgataatattttacagttggcaaagtatataagattatatataattatatatataatatatgtaagatgtatttgcatatgttaattttaaatggacacaattgattttgtatggacttatatactctggtgttatggctaaaggcatgtagaaatagatataatctcaatatttagtttactgctaattgcttaatacataagaatattgattgaattcctgaaatcataaaaggttaaagctatgagaaacattagagagcatctaatcctatcactttgtagttgaagaaagtataaactgtcattatgttcataaatgaaatcctttattaaaaaatattgctaaacttagggaaattgaagttttagtaataattgatatatttaatggtgacaaaagaaaagaaggtttttttttctgcattttacttttcaagtccactattatataaggttaaatattcaacttactagtttttaaaacagtaaatacagcatattttcttttaaaaagaaaagtaaggccagacgtggtggcttacacctgtaatctgagtactctggaaggttgagatgggcagattgcttgaacgtaggagtttgagaccagcctgggcaacatagaaaatcaccatcaccacagaaaatacaaaaattagccgggcatgcctgtagtcccagctgcttgggaggctgttgtgggaggattgcttgagcctgggaggaggaggttgcagtgagcagagattgcctcactccagcctgggcgacagagggagtccctgtctcaaaaaaaaaaaaaaaaacggaaaaaaaagaaaagaaaagaaaaatagggctagactaaaacatatactatataaccatagactttaccctccttggctctgtttctcatgtgttaaaagagtaataacttatatctaaattacaaattacagtttctaaagcatttttttcatgtgttttctcattttctccttgtaacatccccgtgaggtgggtggtattactctctttttatatatgaaaataacagcctcaaagatacttatgcctttgctcaagatcacatcacataagtggcagatctagaattcaaacacaggttttccggcccctcaatccagtggtctttctattacatacacaggtaggcaaaaattttcttggtgaagtcgtcatgaatcagggcattccaaacttgtagatacaaagattgaaacacttacatcaccataaggtcttttaaaaatatatctaaattgttgttctcactaacagcatttctcttaattattaccaatggaggcgtaacgatcaacaaaaccctgttccttattaattagacttgacagaaataaactgaccctctctagacagagggaattaattgatcagtctaacctgatgccagcagtttgtccttggcagcaactagtcagcattctaactggttgcctctcatctatatcactcaacttaaaaggaaatttattttgtttatatcaagggaacattgttcatttttaatcctgctttaggcttacaatgaaatttacaatgaagatattatatgataattttgttgataccagatttatatgtgatactttaaagagtttgcataaattattacaacagctggtaaaataattgtgaccatttaatcaacacagcagttaaattgtatatttactttcattgttttatattgcttggcagaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggtattttctaatgttaacagttttatctatttgaaagtttaacaatgggtacaactgaaagaaatcctatttgccttttagtttataagttggaaaaaaattaagtgagcagtggttctatagtataatggtatctaagaggaaaataaaattaacttaaaatatgagaatttagagggaccagtagtgcgagcagtggcttagcattgctgttactagaacaatgccaatgattatgacttagtactaacataacaaccttcttattaaatacaagccaatctttattccttttatcagcacacaggctatttgtaaatcccttttccagaatttatgattcttttatttcctctgtggatggcaaagcaaatcattatataaatgtttttaatcttattttgcatatttaatgcatacaacatttttaggtattgtaataaaacactgaaaatgggtgtagccaccaaatctataaaccaaacatatgcaaatatggaaaatcttttgtaagttatcttataatatctggtacagtacttttcaagtaatttttacataaaaaatatcattattatagaaacaaaatatgttattttccaaggactatattttgtttacatgcatagtcctcattaagaattgctgatacagaataaatatatgtcatcctttaagtatttactttgtgcttcttcatatttgaaataaaaagtatttataagtgtttctgtatttattgtttcaaatatctatttgtagatatttccgtggacatattttagttaatctcatttcttagaatgttttctcataatgtgatatttagcaggcttctttcacaggaaaattactttctttaaatgaagtattagtctttctgtgaaatagatataatccagtgtaaatatttaggggaaatggttctaaatttacagacagaatcttgtttttcttttcactatacttacaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacgatgattgtgttttgttatatcttcaaaaatatagctagtgaaatattgtgcttaatttttttctattgtgttattcatgaaaatatttaatattcactgacataaaattaatataaagtaaaattcaccattttaattataataaaaataaagtatataattcaatggttgtcagtatattcacaatgttgtgtccactgtttaattccagagaatttttatcacccaaataagaaacaaagcaccaattagcagtctcttcccattttcgcccaacttatcccccacctccatcccttggcaaccactaatctgccttctatctctatggatttgcctattctgaacatttattataaatggaatcaca

SEQ ID NO: 5752 - DNA, 86721 bp, human
gatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagctgtatgttgaaaacccatgttctcaaagccttgcgcattttaagattcctattacgtagtgatttttctgatcttagctcgttgtaggaattaggcactaaagtactgagcaatgctgcagagttttgaaggaaagtttcaggtttccttaagcccagaaatggcaggattggttttctttttgaattttgtgttttgttaaattagggaaccctgcttccgtgggaatttgcaggaggcctgattggcaagtttaagaatgaaggaataaattacaaagaaaagattgaaaatattgtgtaaaaagatggatgatttttgttttgttttgctttttaactgactgaagtaagggatttgggagaacatattgcagatgttgaaatggtgaagagagagatcagatggttatttgtagctctaaggaaatgagcaaacagttaataatgtccagagacagaccatatacttcaaagtgtagttttaggttcccagattatgttaaatgaacagaaaaaaaggaatttgcaagatgaatgagagtggagaggagtcagtcgcttgtcctacttcttttcctttgctgtttttccactgtctccagtctagtggtttactgtctttgcctaggctcagtgcttacaatagctttgttaactgttccctacccacaggttttcccttctccaatctgtcttaaatactaattccaaattaatctctttacatgttgtccttaaaacaacctcaagaggtgggtactattacattaattttacagatgaagaaactgaaactcagaaaaatagttttcctaaaatcatatggttagtacattccagagttaggaactccagaggccaccttcttatttttttttaattatactttaaattctagggtacatgtgcacaacgtgcaggtttgttacataggtatacatgtgccatgttggtttgctgcacccatcaactcgttgtttacattaggtatttcacctaatgctatcactcctccagccccccaccccccgactggccccggggtgtgatgttccctgtcctgtgtccatgtgttctcattgttcaactcccacatatgagtgagaacatgtggtgtttggttttctgtccttgtgatagtttgcttagaatgatggtttccagcttcatccatgtccctgcaaaggacatgaactcatccttttctatggctgcatagtattccatggtgtacatgtgccacattttcttaatccagtctatcactgggacatttgagttggttccaagtctttgctattatgaatagtgctgcaataaacatacatgtgcatgtgtctttattatagaaagatttataatcctttgggtatatgctcagtaatgagattgctgggtcaaatgacatttctagtctagatccttgggggatcgccacactgtcttccacaatggttgaactaatttacactcccaccaacagtataaaagcattcctatttctccaaaccctctccagcatctgttgtatgattgccattctaactagcatgagatggtatttcattgtggttttgatttgcatttctctcatgaccagtgatgatgagcatttttgcatatgtctgttggctgcataaatgtcttcttttgagaaatgtctgttcatatcctttgcccacattttgatggggttgtttttttcttgtaaatttgtttaagttcttcgtagattctggatattagccctttgtcagatgagtagattgcaaaaattttctcccattctgtaggttgcctgttcactctgatgatagtttcttttgctgtgcagaagctctttagtttaactagatcccatttgtctattttggcttttgttgccattgctttcagtgttttagtcatgaatctttgcccatgcctatgtcctgaatggcattgcctaggtcttcttctagggtttttatggtgttaggtcttacatttaaatctttaatccatcttgagtcaatttttgtatacggtgtaaggaaaggatccagtttcagctttctacatatggctagccagttttcccagcaccgtttattaaatagggaatcctttccccattgcttgtttttgtcaggtttgtcaaaggtcagatggttgtgatgtgtggtgttatttctgagacctctgttctgttccattggtctatatatctgttttggtaccactaccatgctgttttggttactgtagccttgtagtatagtttgaagtcaggtagcatgatgcctccagctttgttctttttgcttaggattgtcttggccatgtgggctcttttttggttccatatgaactttaaagtagttttttccaattctgtgaagaaagtcattggtagcttgatggggatagcattgaatctataagttactttggacagtatggccattttcacgatattgattcttcctatccatgagcacggaatgttcttccatttgtttgtgtcctcttttatttcattgagcagtggtttgtagttctccttgaagaggtccttcacatcccttgtaagttggattcctgggtattttattctatttgtagcaattgtgaatgggagttcactcatgatttggctctctgtttgtctgttattggtgtataggaatgcttgtgatctttgcacattgattttgtaccctgagactttgctgaagttgcttatcagcttaaggagattttgggctgaaacaatgggattttctaagtatacaatcatgtcatgtgcaaacagggacaatttgacttcctcttttcctaattgaatacccattctttctttctcttgcctgattgccctagccagaacttccaacactatgttaaataggattggtgagagagggcatccttgtcttgtgccagttttcaaagggaatgcttccagtttttgtccattcagtattatattggctgtgggtttgtcataaatagctctcattattttgagatatgttccatcaatacctagtttattgagagtttttagcatgaagggctgttaaattttttcgaaggccttttctgcatctattgagataatcgtgtggtttttgtcattagttctgtttatgtgatggattacattaattgatttgcatatattgaactagccttgcatcccagggatgaagccaacttgatcgtggtggataagctttttgatgtactgctagattctgtttgccagtattttactgaggattttcacatcgatgttcatcagagatattggcctaaaattctccttttttgttgttgtgtctctgccaggctttggtatcaggatgctgctagcctccagaggccaccttcttaactattactgttaactcactgcctggaagagtgaaagtactaaaaaaaaagttagcaattttttcatcctaaaacaccactttcttatattactgaagacaacgtaggcagaaatacttaaattagctctccattgactatcgaactaaacctaaattatgttgctaaacagttttcaccataatctaggcccacactattcatacaatcttacttagtgctcccccaaactaacttccctatgtacgtaatcattgttgactacctgctgcaatcatcatgcttatgatcactctcatgcctttgctcttcctgtttctttcttcaccttctccccacattctcataaccttttctgccctctccacttatccaactcttgcctttgctagacacaactcaaaatctttatacaaataatcaggcaaaagtaagtcagcatgatctagtcaccctcctcattgccaacatcagggctactgctattgcacttttcggcctatgcaacaggagactctttcttctgttttttttttttcattttgcaaaatgaacataatttgtcttatactaccgtagtatgacatccctttcccttctcaagtggacactgctatgctctcacccctcactcagaactaagagtctccaggtgagttattttcatttgccacaccaaaagtagctgaattttcttgatcagcaaataccccctcagcagaagcactctttatcatcactgagctctttggagttgtaattcaccctcttttctcgccctgataattcctcactttcctcttgaggtctttgatatttttcatgtattataaaataccttccaatattttaaattccctttatcaagagagttccagatcacctatccccaccttttccagaagcagaaattttacctacttttaaacttttgagaaagttaaaatattatttacctacaaaacactacaaaattatggtgtagaaatgtttaatgaactgtctgaaaaacattatcatgtcaacttcattgaatattaagtttactatttgtaaaaatttcatttcatttgaaaacaatttggagtttacatttttatctcacataagcagaattcctgtttctgcagagaaatcactgtcgagcatattttaatgaattgcttgtggctgaaaattttttaaattttaaaacaaagttatacaaattttagaatatgcttaatatttatatttaagtgggattataagtacatttgcatttttatgtttgatacactgtgaagtggtgtgtattagtctgtttcacactgctataaagaaataccaaagactgggtaatttataaaggaaagaggtttaattgactcacagttctgcatagctggggaggcctcaggagacttacaatcatggtggaaggcaaaggggaagcaagcttggaccttctcacatggcagcaggagacagaagagggaggagcaacgggggaagagctccttataaaaccatgagatcagctgggcacagtggctcacgcctgtaatcccagcactttgggaggctgagatgggcagatcatgaggtcaggagattgagaccatcttggccaacaaggtgaaaccccatctctactaaaaatacaaaaattagccaggcgtggtggtggccgcctgtaatcccagctacccaggaggctgaggtgggagaattgcagggagaggttgcagtgagccgagatcacgccactgaactccagcctggcgacagagctaaactcctcaaaaaacaaaacaaaacaaaaacaaaaaacaaacaaacaaaaaaaacccatgagatctcatgagaactcattcactatcactagaccagcatgggggaaaccacccccatgatccagtcacctcccacctggtctctctctagacatgtggggattatgaggattacaattcaagatgaaatttggatggggacacaaagcgtaaccaaatcttcccgtttccaaagtaagaatgtctggagtcttggtggtcttcaaagagccttgatttttagaagaaccaacaacatcactcaatgatgccctagtgcccaccttcctgcctcctctggcagatgggagaccagtaatataaaattttttctctattaacacacaacacattaacacataaatatgtaaatcacatacaaaattaccgcacattggaggatatactgttgttctcttcaagtgccagcagaaggggagtatctgcagaggagatagggtaggttaagtaacagagtgttatgcttaagaattcttatcctgtctcagtcacctgctatgtagtgatgtgcatcagcaggaagcaacattgactccttaccagagggagtcctgaagtattgtgttcagaggtctgatctcatcccagatggtacgttcatgattagagccactagagggcgccactcagctatagaaaaacaatgtggaaggctttgaagcgccggacttaagagatgtaatttttattagctctttacagaattccagcagagggatagaatgtcatttcatgcgttgtccctgagcagtaacagtaaatggtctcaaggaaaaataaggctctactcaggagcatcccctatttccaaaaccttctgatagtttgagtaagggttactgccccactcttccgttgggtatcactgactccagaggaggagcgaataaatttggttatcattggaaagagacaggatagggatagggtggaattttaaaccccttaaaacctcagaagtcactctaaccctctgtgatggttaatactgagtgtcaacttgaatggattgaggatgcaaagtattgttcctgggtgtgtctgtgagggtgttgccaaaggagattaacatatgagtcagtggactgggagatgcttacccaccctcagtctggctgggtaccatctaatcagcttccagcactgctagcataaaagcaggcaaaggaacatggaaggactagactggcttagtctcccagcccacatctttctcccgtactagatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtgtgagtcaatgcttcttaataaattcccctttatatatacacctatcttattagttctgtccctctagaaaaccctgactaatacgctctctatcttccccccacatcctaccagtaataactccatagagtggttgtccagaaattacttatgaacacctccagttacagtgagctgaaaattccagaggcatttccattctgcttttagtcagcttaaaacattagaacattattttctgagattaagctgagaactgtttcctttcatgtttctttgattctaataattacccattataaactcatctttatccttgtaatatgaagccttctcttctccaacttagtatttcctgtttctctagccattcttcataagctgtgatctctagaggtgtcactaaatatgtttcagtttgtcagtttctctcttctacaaaaggtcgtcccagaattgaatgtcataatccaagaatggtatgactagcattgtataaagtagtgtaaggtcctcattctggacactttgtttctcttttagcccttttattttctgaggaatagtatttcacagtggttttaatttacatttcactgattactaagaagttgtgcatcttttcatatatttattgccatttatatattttcttttgtggaatatctgttaagaactttttctatttttctatatttttttgtctctattcctaatagcaacattttgtccctatgtgttgcaagtaacttttatcctgaggctagcctttttttaaacatttttaattagtcatatataaaatatttttctttatggttaatgcttttctgtgaatttttaaagaaatctttccagaccctgagaacgtgaaaatgttatcttacatttatttataaaagctttattgtggtgctttttacatttagatctacattccacctggaattgatttgtgtgtaaggtttgagatatatgtcaagtttaatttttttcaaatagctatccaattattctagcaccaataattgaaactacacccttttcccactattttgcaataccatctttgtcaaaaatcaaatgattatacatgcgtgagtctgtttctggtgtctgtattctgtttcatttgtctatttgtctacccttgtgccattaccacactatattacttattataaatttaaatatcttgaaatgtaatatggcaaattctcctactttggtcttcttcatgaagtgtcctgactattcattgccctttatatttccttttaaaaaggtagaatgtttataaccgcaatatacaaatacaattgattatagtatgttgaccttgtatcaagtaattttctaaactcatatgtgaatattaatagtttatctgtatattcttttacattttctatttacacaataacatcaaccataaaaaatggcagctctattttttcttccaatcttatactttttattcattttcatttccttatttcctttgacacctccagaacactcattcctttcaccattgttgtgtaacaaacaaccctaaagcttagtggcatgaagcaaccattttattatactcacagattctgcaggtcaagaattcagccagggcacagaggtgactacttgtctcttctctactgtaattaggacgtcagctggaaagccttgaaggctgggagtcacttgatggctgcaggctaaaaccatttggaggtttctttatttgtgtttctggtgcctttgttgaaatgattcaaacattaagctcagatgtaaatgttgactagagtgcctgaatatggcttcaccacatgactttctcatggcatggcagcttcagagagttgatcttctcatactgcagcttacagcccaatgaacaaggcagaaactagatcatcttttatgaccttatcttggaagtcacatagcatcatttctccgaacagctataatccagaaacaagaaaaacaacacttgaatggactccaaaggaacctttaaggtgacttggataggctccaaaagcaaaagttatatgtctttgaaaaaagatagcatcatctggagcctcattgttagtaccacattttcatctcaaagtctagcactcgattgaaaataatcttacctaaaaaaatagatgtgactgaaaactaaagactagaaaagcacacaaaaattaaaaagaggtattaccatcaaaggagtagcaaaaaaaaaaattattgctgactgtacatcagaacaaatgagaggcagaagacaatgaaaacatggcttcaatgttctaaaagaatataactgtcagcatagaatataactgtgctaaaataataactgtcagcatagaaatctaaagccaacaaaaatatcccttacaaactaatgtgaaataaagacactttcatataaacaaaagagaattattcaccaaagttttacactaattgaaatactaaagaatgtatttcgggtaaaataaaaaagattatagctaagagatgcagcaagaagtgaagaacaacagaaatggcaaatatctgagtaaatctgaatgagcaatgtgtaaaacaataataacaaatgtcttgtgagtttaaaatatgtacagaactaaaagacataagaaaaatttaaaattgtatatataaataaaaaccttcccacaaagtaaactataggcccaggttgtttcattggcaaaatttaccaaacatttaaagaataaataatgccaattttacccatattcttcaatataatagaagaaaaaggatatttctcaatcatttcaagggcagcttagtgttcattccaaagcttgatgagtacatttcaagaaaagaaatacacaggccaatctcatctcttgaaaaatagaagcaaagttactaaactaagtagtatcaaaccaaatccagtagtatataaaaaggatagtactttatgaccaagttgggttattctaattgttaagcagaacactgggcatcacttgctaatcccaggaattgactctaatcacatatgcccattgcatcgctttatcagagtcatgaaggagaacataatgcagtcaagccctggatgaaacaacactttacttatatagaaaaaaaacagagcacaatcagcttcaatagtgtgtgttggtaccctccatggctagacggtaccccctagcaacaaacacagagcaactggataagcacacccttcttgtgccttagaaaaaggacccttatccacacccacaccaacccagtctgaaagacagaaagctaggacatgtctgagagccatggatgcatacacttagtaaaacaaaagaacacttagtaagtctgaaacagaaaaatatttctagcctggaacagggtgtgtaggctgcttatctcttgctaaggaaatattttagtcccaatgcctattttaaatggccatgtgggggtcaaaagactgcatacacaagattgcctttcccaacactaagaattcagggttggttcaacacttgaaaagcaatcaatgtaatgtgcctcattaacttaagaaagaagaaaaatcacatgatcatctcaatagatgaagaaaagtaatgtgataaattcagcttcccttcatgattgaaaattagcaaactagaaataaaaagagcctctttaatctgataaaagatgtatataaaaagctaaagcaaacagtatacttagtggtgaaatattaaacttcttcctgtgacaatgggaatgaaacatgaatacctgctattacctcttctactcaacatagtgctagatattctaggcaatataaaagaagaaaaataaaataaagttataatttttggaagggaataaatttaaatgtaaccaattgtaaataatacacatgtatgtagaaaatacaaaagaaaatctaataaactattttaaataataaattgtttgagcaagataactgcctgcaagatcaatatgtaaatagaatggtatttgaacatattagtaacagacatgggaaataaaaatgtttaaacataccatttaagataaataaaacaatattgaaggaaaagaacagagttggaggactgacactacccaatttcaaggcatactataaagctacagaaatcaagacagtgtggtattggtgaaagaacaaatagatcaagggaatagactagagagcctagaaatagacctacattaatacagtcaactgacctttaataatgaaggcaattgagctaataaggtagttcttttaacaaatggtgctggaataactggatacctgcatgtaaaaaaaaatgagtctagacatgagattttacacccgttacaataattaactcaaaatggatcactgacctaaatttaaaatgcaaaactataaaactcctagaagataccataggagaaaatctaggtgactcagagtttaacaatgacattttagataaaacaccaaaaccacagtccataaaagaaataatccgtaaccttaacatcattaaaattaacaaatttcttacagagaatatgaaaatttatttagatagagagtagattggtagttgctagaggctggtggtgagggtttgggaagaatagaggggttgggaggtgagaactaaagggtatggggtttatttatggggtcgtgagaatgtcctaaaattggttgtggtgatgattacataactgaatatagtgcagataaaaactattagattgtaccctttaaaggaataaattgtataatatatgaattatactttaataaatctgttaccaaataaaatttaaaagttcagctctgcagaagacactgtcaagagaataaaaagagaagccagagactgggagaaaatgtttacaaaagacatatccgataagggacagttttacaaaatatacaaataacaaaatatacaaaatatacgaatacttaaaactcaacaataagaaaatatacaaatacttaaaactcaacaataagaaaacaaacaaccaaataaaaatgggccaaagatcttaagcaacacctacctcattaaagaagttatacagctggcaaatatacatttgaaaagatgctcagcttcgtatgtcatgatggaaatgtaaatgaaaacaacaatgagataccactacacaactattagaataaccaaaatccagaacactgacaacagcaaatgctggtgagaatgtatagcaacaggaacatcattcattgctggtggaaatgcaaaatggcccagccactttggaagtcagtttggtggtttcttacaaaatgaagcatactcataccatattacccagcaatcatgctgcttggtgtttctccaaaggagttaaaaacttatgtctacagaaacaagcacatggatgtttatagcagctttattcacaattgcctacacttggaagcaaataagatgtccttcagtacatgaatgaatagattaactgtggtacatccaaaaatgaaatattattagatactgaaaagaagtgagctattaagccatgaaaatacatagaggaaacttaaatccttactattaagtgaaataagctagtctgaaaaggctacataccgtatgattccaactatgggacattatggaaaaggcaaaactatggatacagtaaaaacatcagtggcttccaggggctgggggtaggtagagacaaataggtagagctatttgaaaatattctatttgaaaacacacagccagaggagacaaaataaaaaacaataaaaaacaagtacacctacaggatctagaaaatagcatcaaaggggaaaatcttaacacagttattggctttcaagaataggtagagaaagagagactctcgggcagcagactttttggtggaaaccttacagtccagcagtgctggaagaagaaaacttttactctagaatagtatattcagcaaaaatatccttgaaacataaaagagaaataaagactttcccagacaaacaaaagctgagagatttcattaacaccagacctgtcccacaagaaatgctaaaaggaggacttcagtcagaaataaaagaacattaataagccatgagaaatcatctgaaatacaaagtaaactggtaataatgagtacacaggaaaaaaaattgtagcactgtgactgtggtgtgtaaactactcttaccttaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcagggacaaaaaaccaaacaccgcatattctcactcataggcgggaattgaacaatgagaacacttggacacaggaaggggaacatcacacatcagggcctgtcgtggggtggggagaggggggagggatagcgttaggagatataactaatgtaaatgacgagttaatgggagcagcaaacgaacatggcacatgtatacgtatgtaacaaacctgcacgttgtgcacgtgtaccctaaaacttaaagtatatatatataaaaaaagtagaaagactaaatgatgaaccagtcaaaaacaataattacaacatttggctgggcacaatggctcacgcttgtaatcccagcaatttgggaggccaaggctggtggatcttttgagcttaggagttcgagaccagcctgggcagtgtagcaaaaccccatcagtacaataacaataataataataataataataataataataataataatattctgtgcacagtggcacatgcctgtagtcccagctactcaggaggctgaggtgggaggattgcttgagcccaggaggcagagattgcagtgagccatgattttgccactgcactccagcctgggtgacagagtgagactctgtctcaaaaaaggaaaaataaacaataattacaacttttcaagacatagacagtacaataagatataagtagaaacaacaaaaagttaaaaaaaaggaatgaagttaatatgtatggtttttaataattttctttttgcttgcttgttaggttttttattcaaacagtgtaaagtttctaactaaaaataatgggttataagatagtaacctcttgtaaggttgtaagcctcatggtaacctcaaatcaaaaagcatacaatagatacacaaaaaagcaagaaattaaatcatacaatcaaagaaaatcacctttaataaaagaaagacaggaaggaaggaaagaagaaagaggaaacacaaatcagccagaaaacaaataataaaatggcaggagtaaatctttacaatcaacaataacactgaccagaaatgaactaaatgctcaagtgaaaacacatagactggctgaatggatttaaaaaatacccaattatctgttgcctgcaagaaacacacttcccctacaaaggtgcacatggatcgaaaacaaaaagatataaaaatatattccataccaatggaaacaaaaaaagaggaagagtagctacactaatatcagacaaaataaatttcaagaaaaaaattctataagaaggaacaaagaaagacactctataatgatgaaagtgtcaatacagtcagaaaatatgacaatttttaatgtaaatgcacccaacactggaatacccagatatataaaacaaatattattagagctaaagagagacagatgccccaatacaataatagctggagacatcaaacacccgactttcagcattggacagctcttccagaaagaaaatcaacaaagcaacattagaaataatctccactatagaccaaagtgaactaacagaaatttacagaacatttcatccagtggctgcagaatacacattcttctcagcacatggatcattctcaaggatagaccatatgtacagtcacaaaacaagtctttaaaaatttttaaaaatattgaaataatatcaagcatcttctctaaccacatggaataaaactataaatcaatgacaagagaaatttaggaaattataaaaacacatggaaattaaacaatatgctcctgaatgaccggtggatcagtaaagaaattaggaagggaatataaaaattggttgaaacaaacgataatgtaaacacaacataccgaaatctatgagatacggcaaaagcactactaagatggaagtgtatagctgtaagtgctacataaaaaaatacttcaaataagcaacctaataatttattgtaaagatgtgcttattttacattgcatgcctatatcaaaacatctcatgtaccccataaatatatacacctactatgtacccaaaaaattaaaaattaaaaaattaaaattaaagtcaaagaactagaaaagcaagagcaaacaaaacacaaaattattcaaagaaatgatatcagagctgaaattaataaatatgaaatgaacaaaataatacaaaagatcaatgaaacagaaagttggtgttctgaaaagataaattaacaaacctttagtcaaactaattctgaaaaagagagaagacccaaataaaatcaatgttgaaatatgtgacatttcaattgatactgaagaatttcaaaggatcattagtggctactgtaagcaaccatatgccaattggaaaatctagaagaaatggatgaattcctacacaaatacaagttaccaaggttgaaccatggataaatccaaaacctggacagatcagtaacaactaatgagattgaagccgtaatagaaagatttttagtaaagaaaagcctggcacccaatggtttcactgctgaattccaccaaacatataaagaagaattaataccaacctactcacactattgtgaaacatagaagaagaggggacacttttaaattcattctatgaggccagtattgctctgatacaaaaaaacaaagacacatcaaaaaaggagaactataggtgaatatctttgttgaatattgacacaaaaatactcaacaaaatacttccaaactgaattcaatcacacattaaaaatatcattcatgatcaccaagtaggatttatcccattaattgaaggatagttcaagatatgcaaatcaattattgttatacatcatataaagagaatgaaagactaaaatcatatgattatttcaattgatgctaaaaaagcatttgaaaaaaatccaacatcccttcatgataaaaaccctaaaaaaactgggaatagaagcaacatacctttacatagtaaaagccatgtatgacagacccatagttagtatcatacttaatgaggaaaaactgaaagtcatttctctaagatcaagagcatgacaagggtgccaacttttgccattgatattcagcatagtactggaagtcctagttagagtaatcagaaaagaggaacaaataaagggtacccaaattggaaaagaaaaataaaattatccttgtttgcagatgatgtaatcttatatttgataaaacctaaaatctcctccaaagagctattagaactaatatacaaattcagtaaagttgcaggatacaaaatcaacatataataactgctagcatttccatatggcaacagaaaacaatctgaaaaataagtcaagaaagtaaccccatttgcagtagctacaaataaaataaaataactgggaattaacttaatcaaagaagtgaatgatctctacaataaaaactataaaacattgatgtaagaaattgaagaaaagaaaaaattggaaaggtattccacaatcatgaatgggaagaattaatattgttaaaatattcatagcacccaagcaatctacaaattcaatgtaatatctgtcaatgtaacaatgacattcttaacagaacaaaaatctaaaaatttgtatggaaccacagtaaacccagaatagccaaagctattctaagaaaaagaacagaactggaggaatcacatacctgacttcaaattatattacggagctatagtaactaaaacagcatggtaacaccataaaaacagacacacagaccaatggagcagaatagagaaaccagaaacaaattcacacacctaaagtgaactcattttcagcaaaggtgccaaaaacatacactggggaaaagaaagtcactttaataaatggtgttgagaaaactggatactcattctcaaaagaatggaactaggtcccgctctcttgccacatagaaaaatcaattcaaaatggattaaagacttcacctaaggtataaaactaagaaactactgaaagaaaacattggggaaactctccaggacattggactaggcaaagatctctttgagtaataacccacaagcataggaaaccatagcaaaagttgacagatgatatcaaatcaagttaaaaagcttctgcacagcaaaaaacaaaaacaaagacaaaacaaagcaaaacaaaaaaaaaaaatcaataaaatgaagagacaacccacccagtgggagaaaatatttgtaaactacccacctgcattactcagttctaacactgctataaagaaatatgtgagacggggtaatttgttttaaaagaggtttaattggctcacagttctgaaggccatacaggaagcatgattctggcatctgctcagtttctgggaaggtctcaggaaactttcaattattgagaaaggcaaaagggaagcaagcatgtcttacttggccagagcaggagcaagggggcagaaggtactatacacttttaaacaaccagttctcacaataattactattgtgatgacagctccaggagggatggtattaaaccatgagaaactgcccccataatccagtcatctcccatcaggccccttctccaacattggctattacaattgaatatgaaacttgggtgaagacaaagatccaaaccatatcattccaccccggcccctcccaaaactcatttctttctcaaactgcaaaatacaatcaggccttcccaacaggccctcacagtcttaactcattccagcattaactcaaaagtccaaatttcaaagtctcatttgagacaaggcaagtcctttccacctaagagcctgtaaaataaaaaacaagttagttacttccaagatacaacagcaatataggcatttaataagcactcctgtttcaaaagggagaaatcatccaaaataagggactacaggccccacacaagtctgaaacccagaaagaaatttattacatcttaaatctccaaaataatctttgacaccaatgtctcacatccagggcacactggtgcaacactgctccaacccctcatttcccctccatgctgccctagcagaggttctccatgagggctccacccctgcagcagcttctgcctgggcatccaagcttttccatacatcttctggaatccagatgtaggctcccaagcctcaactgttgtactctgcacacccacaggcttaatacaacatggaagccaccatggcttatggctttcaccctctgaggcagtgacccaagctgcatctgggccccttttaagccatagctgggattggagcagctgggatacagaaagcagtctcctgaggctgcacagggcagcggggccctgggtctggctcaggaaatgattcttccctcctaggcctccaggcctgtgatggaaggagctgccaagcaagtctctgaaatgctttcaaggcattttttttttcattgtcttggctatcagcacttgcttttctcttagttatgcaaatttatgcagccagcttgaattcctcctctgaaaatggccttttcttttttaccacatgaccaggctgcaaattttccaaacttttatgctttgcttcccttttaaatataagttccagtttcagttcatttctttgctgcttagaaatttcttccatcagataccctaaatcatctcataacagaagtgaccaatacgtttcttatcttcatctgagacctcctgagactggccttcactgtccatatcactatcagcattttggtcataaccattcaaccagtctctaggaagttacatactttccctcatcttcctgtcttcttctgagccttccacactcttccaacctctgcccattacccagttcccattacccagttccacttctacaatttcaggtatctttatagcaatgccacactccttgataccaatttgtcatattagccaattcacacactgctataaagaatacctgagactggataatttataaagcaatgaggtttaattggcttattaatggataaagaaattgtggtacatatacacaggcaggcatacaggaagcatagcagcatctacttctgggaaggcctcagggagcttttactcatggcagaaggcaaatcagaaacaggtgtcttacatggcaggagcaagaccaaggaagcttggggtggggggtgccacacacttttaaacaaccagatatcacaagaattcattatcacaacaacagctccaatggggacggagttaaaccatgagaaatcaccccatgaccaattcacctgccaccaggccccacttccaacattgggaattacaattgaacatgagatttgggtggggacacagaaccaaaccatgtcaccatctgacaaggaatttataaccagaatatataaggagctcaaacagttctgtaggaaaatgcctaataatccaattcaaaaatagacaaaagatttgaatagagatttctcaaatgaagacataaaaatgataaacagatatatgaaaagacactcaacatcattgctcatcagagaaatgcgtatcaaaaccgcaatgatatatcatctcaccccagttaaaatggcttttatccaaagaccggcaataacagatgctggcaaggatgtggagaaacgggaacccacatacactgttggtagtaatgtaagtgagtacaaccactataaagaacagtttggaagttcctcaaaaaactaaaaatagagctaccatatgatccagcaatcccactcctaggtatatagccaaaaagaaaggaaatcagtatatcgaagagatatctgtactctcatgtttattacagccctattcccaatagccaagatttggaagcaacctaagggtctgtcaacaaatgaatgaagatattgtagtacatatacacaactgactactattcagtcataaaaaagaatgagatcctttcctttgcaacaacatagatggcactgtaggtcattatattaaataaaataagccaggcacagaaagacaaacatcacacattctcacttatttgtgggtgttaaaaattaaaacaattgaactcatgaagataaaaactagaatgatggttaccagatgctgggaagggtagtggctagacagagagaagttgggatggttaatgggttcaaaaaacagaaagaatgaataagacctagtatttgctagcacaacagtgtgactatggtaaaaaataattatacctttttcaaaaactgaaagagtataattggatagcttgtaaccaaaggataaatacttgaggtgatggataccccatttacaccaatatgattattatgcattgcatgtctgtatcaaaatatatcacgtaaccgataaatatatgcacatactatgtacccacacaaataaaaaataaataaaaaaccaaaaaatttaaaaataatttaaattttaattaataatgaataaggtttggtgttaaagatgtgtgaagggatatataaattgtctctttttaatgtttttttattatactgtaacttctagggtacatgtgcacaatgtgcaggtttgatacataggtatacatgtgccatgttggtttgctgcacccatcaactcgttgtttacattagatatatctcctaatgctatccctcccccaggccccacccctgacaggcccctgtgtgtgatgttccccgccctgtgtccaactgatcacagtggtcaattcccacctacgactgagaatatacagtgtttggttttctgtccttgtgatagtttgctgagaatgatggtctccagcttcatccatgtccctacaaaggacatgaactcatcctttttatggctgcatagtattccatggtgtacatgtgccacattttcttaatccagtctatcattgatggacattagggttagttccaagtctttactattgtgaatagtgctgcaataaacatacgtgtgcatgtgtctttatagtagcatagtttgtgatcctttgggtatatatccagtaataggattgctgggtcaaatgatatttctagttctagatccttgagggatcaccacactgtcttccacaatggttgaactaatttacactcccaacaacagtgtaaaagtgttcctatttctccatatcctctccagcatccgttgtttcctgactttttaatgattgtcattctaactggcacaagatggtatctcactgtggttttgatttgcatttctctgacggccagtgatgatgagcattttttctggtgtctgttgactgcataaatgtcttcttttgagaagtgcctgttcatatcctttgcccactttttgatggagttgtttttttcttgtaaatttgtttgagttctttgtagattctggatattaggccttcatcagatgggtagattgcaaaaattttctcccattctgtaggttgcctgttcactctgatggtagtttcttttgctgtgcaaaagctctttagtttaattagatcccgtttgtcaattttggcttttgttgccattgcttttggtgttttagacatgaagcccttgcccatgcctgtgtcctgaatggtaatgcctaggttttcttctagggtttttatggttttaggtctaacatttaagtctttaatccatcttgaattaatttttgtataaggtgtaaggaagagatccagtttcagctttctacatatggctagccagttttcccagcaccatttattaaatagggaatcctttccccatttcttgtttttgtcaggtttgtcaaagatcagatggttgtagatgtgtggtgctatttctgaggcctctattctgtttcattggtgtatatatctgctttggtgccagtactatgctgttttggttactgtagccttgtagtatagtttgaagtcaggtagcatgatgcctccagcttttttctttttgcttaggattgtctgggcaatgcgtgctcttttttggttccacatgaactttaaagtagttttttccaattctgtgaagaaagtcattggtatcttgatggggatggcattgaatctataaattatcttgggcagtatggccactttcacgatattaattcctcctatccatgagcatggaatgtttttccatttgtttgtgtcctcttttatttcattgagcagtggtttgtagttctccttgaagaggtccttcacatcccttgtaagttggattcctaggtattttattctctttttagcaattgtgaatgggagttcactcatgatttggctctctgtttgtctgttattggtgtataagaatgcttgtgatttttgcactttgattttgtatcctgagactttgctgaagttgcttatcagcttaaggagatttggggctgaaacgatggggttttccaaatatacaatcatgtcatgtgcaaacagggacaatttgacttcctcttttcctaatcgaatacactttatttctttctcttgcctgattgccctgtccagaacttccaacactatgttgaataggagtggtgagagagggcatccttgtcttgtgccggttttcaaagggaatgtttccagtttttgtccattcagtattatattggctgtgggtttgtcataaatagctcttattattttgagatacgtcccatcaataccctgtttattgagagtttttagcatgaagagctgttgaattttgtcgaaggccttttctgcatctattgaaataaccatgtggtttttgtcattggttctgtttatgtgattgattatgcttattgatttgtgtattttgaaccagccttgcatcccagggatgaagcagtcctgattgtggtggataagctttttgatgtgctactggattcagtttgccagtattttcttgaggattttctcatctatattcattagggatgttggtctaaaattccctttttttgttgtgtctttaccaggctttggtatcaagatgatgttggcctcacaaaatgagttagcaaggattccctctttttctattgattggaatagtttcagaaggaatggtaccagctcctctttgtacctctggtagaattcggctgtgaatccatctgttcctggactttttatggttgtaattattgcctcaatttcagagcctgtttttggtctattcagagattcaaattcttcctggtttagtcttggaagggtgtatgtgtccaggaacttatccatttgttgtagattttctagtttatttgcgtagagatgtctatagtattctctgagggtaatttgtatttctgtgggatcggtggtgatatcccctttatccttttttattgcatctatttgattcttctctcttttcttctttattagtcttgctaactatcaattttgttgatcttttcaaaaaaccagctcatggattcattgattttttaagggttttttgtgtctctatctctttccattctgctctgatcttagttatttcttgccttctgctagcttttgaatgtgtttgctcttgtttctctagttctttcagttgtgatgttagggtgtcgatttgagatctttcctgctttctcttatgggcatttagtgctataaattttcctctacacactgctttaaaagtgtcccagagattctggtatgttgtgtgtttgttctcattggtttcaaagaacatctttatttctgccttcatttcattacatacccagtagtcactcaggagcaagttgttcggtttccatgaagctgtgcagttttcagtgagtttcttaatcgtgagttctaatttgcttgcactgtggtctgagagacagtttgttgtgatttctgttcttttacatttgctgaggagtgtttttcttccaattatgtggtcaattttggaataagtgtgatgtggtgctgagaaaaatgtatattatgttgatttggggtggagagttctgtagatgtctattaggtctgcttggtgcagagctgagttcaagccctggatatccttgttaaccttctttctcattgatctgtctagtactgccactggggtgttaaagtctcccattattattgtgtgtgagtctaagtctctttgtaggtctctaaggacttgctttatgaatctgggtgctcctgtattgggtacatatatatttaggatagttagctcttcttgttgaattaatcccttcaccatcatgtaatggccttctttatctcttttgatctttgttggttcaaaatctgttttaacagagactaggattgcaaccacttctttttttttttttttttttttttttttttttgctttccatttgcttggtagatcttcctccatccctttattttgagcctggtggtgacaaaatctcttggcatttgcttgtctgtaaaggattttatttctccttcacttatgaagcttagtttggctgaatatgaaattctgggttgaaatttttttttaatattttagtacatttattaaattagtaaatgtaatcttagaacatgtattagttctttaagaatgttgaatattggcctccagtctcttctggcttgtagggtttcttctgagagatccgctgttagtctgatgggcttccctttgtgggtaactcgaccttcctccctggctacccttatcattttttcctttatttcagccttggtgaatctgacaattatgtgtcttgctcttactcttctcgaggagtatctttgtggtgttctctgtatttcctgaagttgaatgttggcctgtctttctaggtctttctaggttggggaagttctcctggacaatatcctgcagagtgttttccaacttggtcccattctccctgacactttcaggtacaccaatcaaatgtagatttggtcttttcacatagtcccatatttcttggaggctttgttcgtttgtttttactctttttcctctttgtcttctcattttatctcattaatttcatctttggtcactgatagcctttcttccacttttcaaattggctactgaagcatgtgcatgtgtcacgaagttctcatgccatggtttgcagctccatcaggtcatttaaggtcttctctacactgtttattctagttagccattcgtctaacctttttttcaaggtttttagcttccttgcaatgggttcaaacatgctcctttagttcggagaagtttgttattaccaaccttctgaagcctacttctgtcaactcatcagtcattctccgtccagctttgctccgttgctggtgaggaactgtgatcctttggaggagaggaggtgctcctctgatttttagaattttcaacttttctgctctggtttctccctatctttgtggttttagctacctttggtctttcatgttggtgacctacagatggggttttggtgtagatgtcctttttgttcatgttgatgctattcctttctgtttgttagctttccttctaacagtcaggcccctctgctgcaggtctgttggcgtttgctggaggtccactccagaccctgtttgcctggctatcaccagcggaggttgcagaacagcaaatattgctggctgatccttcctctggaagcttcctcccagaggggcacccacctatatgaggtgtctgtcggcccctactgggaagtgtctcccagttaggctacacaggggtcagggacccacttgaggaggcagtctgtccattctcagagctcaaacaccatgttgggagaaccactgctctcttcagagctcagttggaaatgcagaaatcacccgtgttctgggtcgatcatgctgggatctgccgactggagctgttcctattcggccatagttccatgtagctgggagaggcctcacaattatggcagaaggtgaaggcacttcagtggaaagcaggggctccaacggggtaaaggcatgctccataacagattattggcctacaatagcgggtggagccacagagttgggagcacaggctgcgggagctaaggcgattgactgcttggcatgcggctgaggagcctctgggatatataaattttcaaaatttatttaagggttatggaatcaatatatttaagtgatcctgaagacatgttttcatcttacatttatgaaatttcttcaaactccttataaaaattaaaataaaacatgattgtttattttcctttccacaagtctcgtaactctacaaataaagaaaattaacttaaaactatagttaaccaaaactatatttcataggccgttagtctagaataatgataagtaatacacacatacacacacacacacacacacaaatagaattgttctgtgttcaaatactttgctaaatacctgtttcccatatttatttagccatagaacagattttttaattccagcaccattctattaacatttagtattctgagggacaccagtttgagtaacactggtttcgcataatacattcttagtgaatccacattgacttttagtaacatccatttctttttccaaagtgctttttaatacatttagaatctttcttagacttccactcttatgttcaaataaataaatcatattcttccatcatcagtcttctgaactctcttttattcttcttagtaagattactaatagttgttgatcagtttcatttactaatcttctcactacttattctaagttgttcccccctaccttgtacagcttgagaattatgacaagagtatcatgtgtgaatgcagagtctatttataagtttttggaatggagtcatatactacatatactataaagcagataaatgctactcttaggaaaaaaatacattgcagaaaagaacacttctatttctacactacaagactttaaaatacttattaaattatttattatatggcaagcagtgtgtattttatgtactttcattttttcatttaactcttcatagaaatcctatgaaataggtattattatccttatttgatggaggataaatctaagacataatatttaagcaatttgctcaaggtcatgtaactagtaaagagagaagcaatgtttcagaagtagatgtattttattctatgtttttaactactatgctatactgcctccctgaggacaaactttatatttattccttagtatctcagaatgcctagtatagtagttgctcaaaaaatatttactgaatgaataactatataaacaaatgtatttcagctgggtcaagggactttcatgcattcaaagaatttatgtactctaggaaaatatctctttccatctttaaacgcctatttactagtgttattctacccttatcagtctgtagaagtctgtctaaatactatgagtgtctttcaaaattaattcttgaaattctgtaaattaaataaaaaggaaaaggagattttaaaaacagcttaacagatttctgcataccctttaataaaggactgtatgatgtgtgaggtctctgtggataaacacataagtgtaataaacatttttttaagatttatttcttattttcctataatgagactattattttactagagagtgatcatcttacatatgataatattaatatcttttgttaacttaggagaaattacagaaaaaaatttctaactttatggaagtctctcagttcactgtcttaatttaacacatatctccaggagttcacatcataaagacaaacaaatctaagtgagtaattctaacataagataacgataaatgcaataaaatagacacaagtaagatgttatgggaagagattcactaagataaggtggacttgaaaaggttacattcattcaaagacagtttactggataactaccacttgccaggcactgtgctcattatgagagagacagcaatgccttaaaacaagatttctacactttaggagttcatagctttgtaggaattaccaataagaaacaaaaagtatagtactcactgaggagtgttatagaaaatagtatatatataaaacacacaaaatagcgtggaagcacaagaaaaagaaatattaaatcttcttgagagaaatggaaaagatttgctgaggagctaattttcctattttaaactgtttttatttatcttgttttcaatgtgtaatatagtcacatgtctcaaaataaagcaacataacaaggtttctattcagaagtcccatttctatcctttctcaatctacatggctcctcctacccctccattaactgcttttattcaatattgtggctacttcgagtgtttctttatgtaaaagcaagaaaattatgacatacttcattttcatttccaacctttatttattacaaaggtagtatactatagatactctacctttccttgctttttttcactgaactctgtatcctgaaaccttctcatatcagtataaataaagagcgggtcttcattctttgtttttcaaacaggtgagtagtactccattgtatgaatgtaccataacttatttaaccagttctctgtgatgtacatttgagttatttctaatattttattaatccaaacagtacaccaataaaaagttttgtatatatgcatacacaggtatatctgtagacataaattctagtaggattgttgactcgaacaaattcatttgtattttttataaatattacaaaattaaccttcatagggattgttctaccaaaatatatgagagtgcttacttcctgaagtttattgctgaacattctttttcattgtagtttaatccatatttctcttttatgagtaaggttgagtatttttcatatatgtcttatcagtttctaaaagtaggaggattaggtcttatctgtgatatcagttgcaaatattttttccagtttttcatttgtcatttaaaatttttttatcatgttatgttttatgatcatgtaaattttttgtttatttgcttttaaagtagttgatattatcagtctttgtttctttggcctggactttttaccaaagtttaaaaggtctttcctgtcactcaattatacaaaaattcactgtttccttcttgttcttttatagttttttttttttacattgggtgtttttttctgggtattcagtgtacataacaacaatctctttacatgtattctttcctttgcttttttctggaatactttaaagcaaatttcagacattatgttagttcactccttaatatttcagagtacatatcaaactaataggacttatttttccacataaccacccagttattaccatacctaccaaaattaacaataatgttttaataacatctaatacccagcttaggttaaaattttcctaattatctcaaagatatcttcttccaacttttttctcatcagcatgcaaacaatgtccacacatttggtttttatgtttcttatgtttattctacagtcccctgtttttctctctattgtgtacataaatttaaagagcagagggaaaaaccaaaagagtgaagtgttgctctttgaaaatggatttacagcctcctcaatttttttttttagggaaagaaagatgatttaaacaagcaaataatatttacctttgttcaagcacatttaattttatcaagacacgattcataagaagtaatttgtttttaatagagctacactttatggaattaatctaggattctttaatttgtttcttgtgaacattcttatcggttttcattttacatacttatcacttatttcaaatattttcttataggaggacaaaataatttcagtaatgtatcataatttgggtacaatatgtacaatgaccctgaaccagtgtgattggaatgtagtgatcaagggttggagtgacttgagatgaagtacaaaaagagaaacagatgctaaaccatgcagcactttctagggccattaaggattttagtttttatcctgagaacaatggtgagttatcaaaaagttttaattttccagttgtatacctttaactcaggaaaaccacggatatttctatgtgtgattaactatctcacataaaaatatacaaggaaatgtaatctttttggctcttattcataaacatgtgattcaaaacaatgaattgttaaataactgagtaaattatgttgtcaagtctggaaacatggcatcacatttctgtacacatttccactgacttccaaagtttatgtagaactagaattgacctgctacctgacacattcagagttcaaaagtttctatttgaaagaaagttatatttataaaaatcaaaagtttatatagtcatattttcaggtgttaacttcagtcctattcatttttcttcttacttacctaaaattcatgtttttctgtgataaaagctgaaatcttatcatctttggttggtccatttataaaatcccaagctctcatatgcagatctccaaagtgttttttgtcactgaatattcaccaaatgagatttaaggaactaacagtacacaaataagatgttagaataaaaacacattctcctgagtctcaatagcgatgtgttattcttgtgacagctgtatacatttttccacactcatttcagtctctcaaaatcaacctccctggaaggcagcatattataatagagagaacatcaggattgaagtcagtttgaacaggatggcaaatacaattctatcacataattgctgtataactcagagagtcacaatctctctgagcctcagttttaacatctacaaaatggcaataatagtacctaatgtgcagggttgctggaaggattgagtgagatagtttaaaggaagcatctggcacatagtagatgctcaacataattatgatgttttcttgtggtatttatcattactaatgataatagagtggggaatttgagatatgttagcgtttcctattatatatattaccagatagctgataatacctcattgataattggtatatttaatcaactatatatcttgttgataatacctcattgacagcatttgaaggatcattgattttactctttatgtcctgggtgcacccacttatagttttataaattaggcaattaacattactagacaaattgattatgcctgattttgattcattttcttaatacagtttacttttatacacttattttcttactagaaaaggaatataaccataattgattttcatttcacaggctacatgataatggatataaaatagagttatgttaacaatcatcaaataatttctctttgactctaacccatttgttttaaaaataggtagtgcttgctctactttgctctattcatggactcagtgcatcacaaatagttttgcaagtacttaagggacatgggtatctctcagatgccgtgagaaccagtcttcttggctactatgtaatgactcttattttcttctccttgctgtagtaatgcctcctatgccaaaagaagctatggaatccattgcctcttaagatatctctcactactgatgactgttgaaggttattgctgctggtggtactcctccatggttttttttttttttttttttgagacggggtctcactctgtctcccaggttggagtgcagtggggcgttgtcagttcagtgcaacctccgcctcctgggttcaagtaatcctcccacctcagcctctcgagtagctaggactacaggagcgcaccaccatgcctcgctaatttttgtattttttgtagagatgaggttttgccatgttgcccagctggtctacagctcctggactcaagcagtcagcccaccttgacctcccaaagtgttgggattactggcatgagccattgtgcccagacaatatttttatactaaggctgctgatgtccactctccttgcctaggagggatatctttgtttttttcttgatatccctctatggctaaaacatgaatctctataaatgagctggatcagtaacaaatctaactgagggatatatgcctattctgtaatttgaatcaccctgtctaatgggactggccaatcatctttgaactcatcttgagttctgtgactttctcttccctaaggacaaattatttaacaaaggttatttggcccgttaggtagctaggatcttggcattgttttttcaagcagttctccaagtatgctcagacatgttaaaagcctaagtggaacagtggttgaggatatgctgatatcccctacaacttttattatactcttccatgtataaaaaaactttatagtacatgttacagtctatatcttcactcatgaattggctcttccaagaatcagataataagcagccctttatctgggcactgtaagcttggttaataggctcagattctcacataccaaatcacatcctcccccaggataaccagagtgatagaacaaaactgggctattatccaggtttcaaattactcctagtgtgaattagcactctttttcaagatgagcattttcccttcagttccttgttctcttaccttagagacacaggcctccaggttttgtttcttctagaaattcctgaggcctctctagaaaagcctatgttcaaagaccactgtccattacaaagtctatgggtatgggtaggcagactcccttacttatgatgacaaccactccaatctcatttctaactctctctctagcttagtgtctctgtttcccatggaaatgagacatagtcaactgtaaacttttcctaggcaaaagacagcctcatccaccagtcttagttcccaagcactgggatcacagacatagaaagtcttctccccaattaatttatagttaataaatcctacttgtagacccgctgtattagatccatcctatttcctgccaactgtttttatacaggctgtggccacaaactttagccccactatataggatgtaagtgtacccctgacattcatttcatactgaaaggggagacgcaaagtctacaatagtactcatcacccatcttgaagttactggtaccaaacttgagcactgacagtactgttgtgactcacagcggtatttcatctgggaatttccaggtgtagtttctcacttcacttacccacatgctagatcaagcttattgaatctccattctcaatagccaatccaaattaggggtctgtggacagtcagccccccaccaaataccccaaagtaaaaggtaaacaaagtgggcattttttagaaccttcatagccacatgataagaatgttatgtgctggttccattaacccttttctctgcccccactgcctgcttcctagtatgtacagcaaagtccaatgaaatattttaagttgtgaatcataaagaggatgttctggatttttgtgtatccactacctctagagtactttgcataatagtccatatatagaggtcacctggaatacttcgcataatagcctatagagagagaagcatttcttccataaaatctaggcaactgtgattagagccctttaatttggggcatgatgggtaaaagaattggtttccaagagtctgctcccacaagttctgctatctggttttaaaaacaagaagtctttgttcattaactctatgagcttgccattaaggattgtttccagataggctgccaaatttggaggtcttttgcagtatgcagaagtttcacagtgtatttaatgtcttcattcacccctggcaaacaaaacaaaaaaaaaatccaggtctaaattagttctagggtcttttcttttttaatagtcacagccattgcttaatgctctcacaagtacctgctcatatcctctgagaaaaataagatgcataaaaaaatcaaatgtttctacttcccttacatagaccaatgcaaaatataacttaattcctggcttactatttttaacttttgtcattcttaaagtaaaatcttagtcacactagaagaatatttttcaaagtgcagatcttaatccactaagctattaaatcagttcagttggtcaaaaacagtatttttataaaaggaagtataagatagaaaaataaatataagaatatgtggcatttagaaaagtaattattttgtgaaacttttgcttcagttatatgtttgtgtgtgtgtgtgtgtgtgtgtgtgtgtgtacacaaatatgtttgctggataaagccataaaatgtatttcatttgtggatagtagtcaaaataattgaagatttaaaatccactgtcatggaagagtcaccaatccccaaggtgtagaaggcctttttctcttagctcatcatgctgtcctctaccccatatgttgaggcaccaagagtttatgcaaggcaacatagctgatagctactacagatactgtctgtaggttgtcctaagttttcaaacaggcttgccttcccagagtgccatgtactctgggaattccaaataaacctaattccctccaaggggatagtttctatttcccgtaagtggaacacttgagatgacatatgcacacctttcttgctaatcttggccctataacatagattgaagccttaaaatgatactcagagaacatcaccacccacttatgcctagtgatatctattctgaaagtggtattcagtcccctctccaagacgagcaagttgtcggagacaataaagaccaaggtaggatgtggtattctgggagtcagtgccagcaattatactgaaatggctgtttgggaccttgttgttcatgtagctgggctgactgagtccaagaatgtatgagactttgcttgaacctttctaaagttcttctttgcatgagtctctcttgaatagcatcaccatggaactagtgcttttctataggcattttcaaattggctatacccaagtggtttgggaccttaaatagccagcatccatgttcttccagttgcggaaggcattgctgtcattcagtactacctatacctcaaggtagttcatgtaacccactgcatttccattaggtgttgtggagtggcagaaacttttgttttccactgacatatccttttaaactgataaagatcatttttaattcatctttatcaactcttagaatctggtgattcatgttctacaaatgtaatacagcgatttactagctttctgataagccactctgtgtatcttatatcagccatagtaattatgtatgacttactatgcatatgcatacatacacaaatagaaagtatacatatgtagtaactatgataatctgtgcccattgaaaaatttccagtttcttattctctcattaccataatagatgaggtatatatatatatggaaagaagaatttggtaataatcccattagtcaattacctttaaaatgatttctcatatcatcagtctgatatagcaattctcctagatcagtcgctattaactgggggcaattttgtcattcaaaagacatttagcaatgtctggagacattttggcttgtcacaactgaggcagtggtgctactggcatctagtaagtagagggcacggatactgctaaacactatacaatgcacaaggcagtccccatctcccccacacagagagagaattatttggtcctaaatgtcagtggtgctgatgttgaaaactcctgttctgatcctaatatttttgttgttgttgtttttaaggacttttaaccaaaataggtcaccaattaactgcagctgatatctgttattacattagcatttagagcattaacgatataatcatttatcataatacacaaaaaaggtagaacaagaaagaataatgtagcttttgtatccatggctgatcctgacgtttgaccctgacatttacttaagtcattcaaacatagtgggctattccttttttacacacttctattcatagagagactataccatggcaataaccctgatcttccttctcaagctttcattcaacttctcagaacttgaagagaccccagtctcaaaattaagttaacttacgtcttagacttggaattttataggataatgccctggaggaaaatagaaaatgagagctgtttgtttctctttgtctctaacttctggtgagctaatgtgtataagacaagtaaggggagttttgttaaggatctatcatcagtctactgctggaaataatattctgggactcgaaaaggctaaaattagcctcaatcaatgttatatacactacaacaggcttgattcagctcatctcagtggcaaatatgggggaaatataatgagttcaattttaaatatcatgagtttgaggtgcctgtgagtcattcaagcggagatgtcaagtaggtaattgagtatatggaattgcacgtataaacagaaatgtaggcatcatcagcttatagacagtaattgaatccatgggaatggatgagaccaactaaggaaaaaatacagatttagaagagaaggtagcccatactgaattcttaggtactttcaatatttgatgtcagataaaggattattccaaaatcgatgacctttccactatatcatgctgtctcccagatagaaagtgagctgcatttaatcattcaataaaatttcacattaagcacctctcatatgccagacactattgtaggcacttgggatacatcagtttaaaaaaaactgacaaaaatctcagagcttaaaagaggttatagtctagtgagtttctttataatgaaacaggggcacccttccacagctcagctgatagagtggaagactgtgggggttataataaaacaagggttacagaaggctttacttccctgctgtaaagcctctaaacccctgaaactctcaatcccctcaccttcaatattagaaagaaatcttagacagcatcttattcttccctttcccctactccagcttctttgtttggtactgcatgtgactagtttttatacaaatttgccagttgccttgaacaaatagataatagagcaaccaagaaattagagagacattgaccttgggtgaaaggaaaaagaaagaatgtcacataaaaaggaatgagaggcattcataataaaataaataacattataggcccaagttaagataagtggacaaagaaatctcagttcctagattgacaaaatataacaaagttgggaaaacctagcaacaaggtattagagagagtgagggtaaggaggtggtcctggtttgaaaatgctagcatgcattaggaaggaacaattagaggaaaatgtggtaaactcacacagctatctttctgattctgtatctttcttattgttatcttggattcagttttactcccatcaagcaacaaattgatgtgagtcacaccacataataaatacattgaactaaaatttcatgataaaacttttgacattctcagcactttaaaaatagctctgttatttgaggggactgggattcacttagggaaagagcacagtaacacataaagacagcttttctgctgcttcttaaaatagcattgattgtgttgggcatctatctgcttttgcacatctctgacatttctgttccaacccaggggccacttttaaacaaatatgaaactacagagctttatgtggcactccaaggacacttgtaaaataattatttccttagttctttgccatgcccctgactgcctagaattgaaggcctatacaataaataacctgtctcagatctcaggaggatattagtgtacaaatcagtgaatctcaaatggagatcgcataagaatctccaggatttagggactttttaaaagtacacattcccccatcctatcccctgtagattattatgtatacctcttatccttacacataaaagttacttctatagagagacaatattacttatgagaaaaggtttcattccttaggttaggaaggtagaaaggttgaagaatactgacgtgtttgacatttttaaatatattccatagatacatctctctaacaaactcccagttccagcagtagtgagttttctatatcagtactgtttccagactaaaacaaacaaatcatcaaaagtctagagatggaattcctcagccagaactgtccagtagaacattctacctgtctgtctagaacttgatttaagattcaagggtactggctatcaggtattgttccagttactatttctatgtgacaagtcacccaaacttagtggcatacaacaattgattcattaatctcagattctgaatcagggtcagaaatttggaaaggacacagcagggatggattgtttgtgctccacagtgtctagggcctcagctaggaagactcaaaagtctgaaggctaatattgtctaaagcttcactcacttccatgtctggcagttgaggatgctgagtatcagtcatgatctcagctggggctgtcagctgaaacacctatgtgtgacttcttcatgtagctgcttggagttcatcacagtatagcaaatgggttacaagaacaagtttccaaagagtcatggagtaaactagctttggaagtcacaaaacattacttgtaccaagtcacaattacactcagattgaatggaggggaacgcagaccccatttcttgatggaagaaatgtcgaagtcacatgttcaaaagagcatgtgggattggagatatacagtgtagtcatctttggaaactacaatttgctataatctgcccactaggtacaataactaatatcctcccaacattcaaagtattctaattccctcctccaagacctctaagtcgcataatgacagcagctcaactacaaggtctcattttctatattaggtccaggtgcagatgaagatcctaaggtttgattcttttgagtacagttccataagcacctcttgacctgaagacatgcaagctaaagttacaagttacctgctctacacattcaacataaaattatggggccaggcctagaataattgccataggccctctcatggaaatggaagaggggatggaaagactgcagcagtcactagttcataacaattctgaaatatagctaagtacatattgccagttccttgttttgtcctactgcttgagatctactctctattacttctcactctgcctctagtctcttggttccattttctgtgtcatctttccttgtttcataaaaaaagcttatgtttgcagctgagtggtttttttttttttttcagtttgttttctcctgtagtagtctggaagtccaaagcacttcattttgtactatctctatccttttaagtccaacctattgcacaattccttgaaaaattttctgtgtaccaatttataatccactctatcagacaaaagccataataagagatttccattgttttttctaccttgggctccctgtgaggctgctgtggtataacccccttaaacttaaaagctccatcacttagcaaaaagagatctgtatctgtccttaagatccttagaaggcctttgttctgtctgaaaggttctaggaggcactgctttacatatttttgaggctttaacaaagagtcccaacctggtttttatctttagcacagagccttttttgatttgagaatctctgtatggagagactgggaaagtgaaatagtattgtattcaaacttaccaagtactgcattctttataataagagtcaaacctttagctcgtatatttccttttgcgttttatcatatgcagtgaaaagaagccaagtggtattttacacatctctatagctagttcatcaagtttactaggtgtatcctatttttcatgttaccacagaagggtgttgctgactttctgctactaaagaacaaggtctccctttcacagagcttccattttttcttactttcctttaagccctcaccaacagcccctttaaggctctgaaggcttttttctatcactctcttcaagagtctttcgtactcctctgcttcctggtccacacattttcaggttttcttataacagcactctacttacaggtaccaaattatatttcagttagcaataattgagtaacaaagcattctaaacttagaggcacaaaacaacaacaattttattatgcttacagattctttgggcttagaatttggaaagaacataacagaaatgtcttggttttgctccaaaatgtctaaggtctcagctgggaatactcaaagactaggggataggagcatttgaaggcttattcattcatatatctggcagtaaatgctagccattagttgggccagaactcctacctgtggtttttccatatcactgattgaagactttatttatagaaataattttgagggtactcattaacatgtgtccaggggtcagtcgtcacaacttggaacatcagatcagtaaggaagcacagctcatatttcacacaatgggcaatattcttggggcaattcaagttcaaacacgcacatactaggtaaccaaaacttctgggtagatgcattatcatgccatccaggatgacatggggtagcaggagccacttaaccccagaagatcctctactctggaaattttataattgtctatcaacagttggaaataactcatcagatataaacaatcagcagatgattatatatgtccttgcttgaggtcctctgtgaaagacaccaaagttgtagactgaactaggaacacattccacagaatgattggttgaagatgtccactcaaaaagtctgcacacaagcactatttacaataacaaacacatggaaccaacccaaatgcccaacaatgataggctggataaagaaaatgtggtacatatacaccatggaatactatgcagccataaaaaagaatgagatcatgtcctttgcagggatatggatgaagctggaagccatcatcttcagcaaactaacacaggaacagaaaaccaagcaccacatattctcactaacaagtgggagttgaacaatgagaacacatggacacagggaggggaacatcacacaccagggccagttgtgaggtgaggggcaaggggaaggagagcattaggaaaaataggtaatcaatgtggggcttaaaacctagatgacaggttagtaggtgcagctacccatcattgcacatgtatacctatgcaacaaacctacacatcctggaactgaaagtaaaataaaaaataataaataaataaaaagcaagaaaagaaaaagaaaaaagaagtctgcacacaagttatttgcctctggacattaccacagggtcttgttaatacactgatagtaaattttctgggatttctattgatcttatatcaggaatgatgtcttcaatatgccacaaattttcctgaatcaagaaacacccaacaaatcctaaacctgctaagatatctttatcaaggttgatatgggattgagaattgagattatacagtaaatacaattctgaatgggctgtcttcatctacaacaacatcacaagcattttttcatgtaattgcattattttcataactagaaatattaaattcaacagttttcccttaagatttaattgcatacaaatatttgaatgataaaaaactcaagtatgtcaataaattatatctacatttcaaatctcagagatgaatattgtatagggattcattttgaagtaaagaaaaagtactcctttttaaattaatacattaaaagttgtgcttttatcataaatatattttttagtattaaaaaactgactatggctcatgcctgtaatcccaacactttaggaagctgagaggggccatggtttgagcccaggagtttgagaccagactggacaacatagtgagacactgtctctatcaaaaaaaaaaaatagaatttcacaggtaagttaagtattaaccaagagagacaaaattatcctaaaacttttgtttacctccttaactaccatttgaattctccctctggctcaaatggttattgattcatcttatcacccaagatgctttggccctctgggtaggactcttattgaactctccacaacttaaataggacatgatcgtcatattatgaaacccatagttttagaagcactacacgtattgatagagatgagctgacagcatttgtgcagacttttctttttttaaatttttatttttatttgaagttctggggtacatgtgcaggatgtgcaggtttgttacataggtgaaagtgtgccatggtggtttgctgcacctatcaactcatcacccaagcattaagcccagcatgcatcacctatttttcctaatgctctttctccccacactctatcccccaataggccccagtgtgtgttgttcccctccctgtgctcatgtgtttccattgttcagctcacacttacaagtgagaacatgcagtgcttggttttctgttgctgcgttagtttgctgaggataatggcttccagctctatccatgtcccagcaaagaacatggtctcattcctttttatagctgcatagtactccatggtgtatatgtaccacattttctttatccagtctattattgatggacatttgggttgattccatgtctctgctattgtgaatagtgctgcagtgaacatacacgtgcatgtatgtttgtaatagaatgatttatgttcctttggatatatacccagtaatgagatttctggaccaaatgctagctacacattatacaaaaattaactcaagatggattaaagacttaaatgtaaaacccaaaactataaaaaccctagaagaaaatctaggcaataccattcaggacataggcacaggcaaagatttcatgacgaaaactccaaaagcaattacaacaaaagcaaaaattgacaaatgggatcgaattaaactaaagagcttctgcacagcaaaagaaactatcctcagagtgaacaggcaacctacagagtgggagaaaatttttgcagcctatccatctgacaaaggtctaatatccagaatctacaaacaacttaaacaaatttacaataaaagaaaaccattaaaaagtgggcaaaggacatgaacagataattctcacaagaagacattcatgtggccaacaaacatatgaaataaagctcaacatcactgatcatcagagaaatgcaaatcaaaaccacaatgagataccatctcacgccagtcagaatggtgattattagaaagtcaagaaacaacagatgctggcaaggttgcagagaaataggaacacttttacattgttggtgggaatgtgaattagttcaaccattgtggaagaaggtatgcagtcttttcattaggacaacactggaaggtaactaagcaatttttggaagaaagcaattatagaactattggttttaatcaaatgtcttactcatacatctcaggacacaacatttgcacattttttttcaggtatataatgccatttaaaacattttacttggctgggcctggtggctcacacctgtaatcccagcactttgggaggccgaggcaggcagatcacaaggtcaggagatcgagaccatcctggctaacatggtgaagccccgtctctactgaaaatacaaaaaaagtagccgggcatggtggcgggcacctgtagtctcagctacttgggaggctgaggcaggagaatggcgtgaacccaggaggcagagcttgcagtgagccgagattgcgccactgcactccagcctgggtgacagagcaagactccgtctcaaaaaaaaaaatttattttacctgggtcagttgataaaattttttatataactccaggaaactcaggcctcataattctgaggaaggtggaatattttaaatatcctatttgatggaaaatatatagactaggtcattctgtccataggtccctatgccatacctatgttggattagtattagcactctggagggtatgtgagttcttgtttatgaggagacgccaatactttcaaggtaggggacagacattgtttaaaagttccagttttggaaaagatgtgctatggaataatgctgccctaaccatgacattcaaggaaacgctttcgacacttttatgtgaacaactgttatagatctctaaggctggtcacctgggatctgtatatacagctgaaaggctacccggtcaaatgcatccacctcttagacatcctgtttcagtctagcaccagctatgactgagtaaatacactagcagaaaacaccttattgcagaaaattcagccactttatgtaaaagtgtgccaggcccactggcaagaaatgctgcagctactcagtaatgataaaatcagctaagccctcctgctttagctttatctaaattaggggggatcttggctgcccatatacccacacactggcagatttcaaggcaatgggaaacttaataatggtccagcagacccagactcacttcaaacctctgccaggctttgcatacatgtaaaggcaatctgcttccaagagagacccactatctataagaatctactagggtagaaaaattcatggaggttctcatgctcatgttggtacttaaaacttaatagttctaggcccataagtgaactataatcagaagcatcctgaactacgagcttcatcttaaacaactgatagtatcagtgcccacaggttattcaggggtgcctgctttatcaatcacactgacaagcagagtgcaagacaagaaatcaatcttcggagaagccatctctcaacagaagacagaagagttaccccatttattcagttattaaatagataattattgtaaacttactatgagataggcccttgggatacagtggtgagcaaagtagacaaaaatccttgccctatggagcttactttctagagcaggagatagaaaatgaaccaaataaataagtaaattaaattgcttattgaaagtgataagtgctgtggagataaataaagcaaataaagggaatacagagattatttttcaaataagtcatcaggaaaggtctcactgagacactaatatttaaccaacgacttcaagtttgaagttggaagacccataggtgtgtagagctctagacagagggaccaagaattgggaatttcaactctgatttaaactttaggctgaggcctcagtcattttgattaaataaaaagtgaatcagcatgatggtagctgttgctaatatgtgttagcctggcttcacttctgtccataccttggcctaccttgatttagatcacattcacatagtacaatgtctgctcccattactactttggaggcaaacatattgcaggaggataccagccacaccaataactacaatgaccatttgatttttagaaaacaaaatgacattgagtattttggagaacaggttgacaaattctattccataagccaaactcatccatttttttaattgaaatttttgttgagagaactatggattcatatggagttgtaggaaatattagagtgataccatatactttacccagtttcccccagtggtaatgactttcaaaactatatcacaaacaggctatttacaagagacaatcctctgaccttgttcacatttctacatatttttatgcactcatttgtttgtgtgtgtgtgttaagttctaagaaattttatcacaaatataggttcatgtatacactatcacagtctagatacaaaccaactccattatgacaaggatccattatgttgtgtttttctaactactgcccccagctccttcccaattactaccctgttcataatccctggcaatctgttatttatttctaaagttttgttatttaaagaatgttttaaaaaggattcacagaatatgtgatcatttggggttggtttttttcactcgacttaattccctggaaattcattcaagctattggatgtagcaattgttcattcctttacattgctgtgtagtattccatggtatagatgttccatagcttaaccattaacacattgaaggacatttgagtttttactgtttgtggctattatgaataaagctgctacgaacattcctgtacagctttatgtgtgaacataagttttaactctccagggaaaaatgacccagagggcaattgctgagtggctgtgccattttacattctcacctgcaacatatccatgatgcatttctccacattcttgccagaattttctaatatctctaatttatattttataattatattatataattatataaattataatatctataatttatatattatataatcagccactctctaattacatattatataatcagccactctctgattacttctaattttctaatgggttgtaaggagttttttggttaagttttaagagtatatatatatatatatatgtgtatgtgtgtgtgtatatatatatatatatatatatatatactgatatatactgatatcctttcttttaggcatatacccggcagtgggattgctggatcatacttttagtagctctatttttggtagctctatttttagtcatttgaggaacttccaaactgtttcctacagtggttgtactaatttacattcccaccaccagtgtacaagggttccattttctttacatcctcaccagcatttgttatttgctgttgtttttggatataagccattttaactgaggtgaaatgatatctcattgtagttttgatttgaatttctctgataatcaatgatgttgagcaccttttcatatgcctgtttgccatttgtacgtctccttttgagaaatgtctattctaatcttttgctcatttttaattggattattatacttttttttcctatagagttgtctgagctccttatatattctggttatgaatcccttgtcagatgggtagtttgcaaatattttctccaattctgtgggttatctgtttactttgttgattgtttcttttgctgtgcaaaagctttttaacttgatgtgatcccatttgtccacgtttgttttggttgcctgtgcttgtgggagataatgctcaagaaatttttgcctggtctgttgtcgtggggagtttctccagtgtttctttgtattagtttcacagcttgaagggtcagatttaagtctttaatccattttgatttgatttttgtatatggcaagagataggagtcaagtttcattattctgcatgctgatatccagatttcccagcaccatatattgaagagactgtcttttccccagtgtatattcttggcagctaccttaaaaatgagttcactgtatatgtatggattaactctgagttttctattctattcctttggtgtatatgtctgtttttatgccagtaccatgttgttttgattactaaagctctgtagaatttaaagtgaggtaataggattcctccagttttgttctttttgcttaggataatttcggctatcctgggtcttctgtggttccctataaattttagaatttttttctatttctgtgaagaatgccattggtattttgataggggttgcattaagtctgtagattgcttagggtagtgtggacattttaataatattgattctatgaggtatttttccttttttttggtatcctcttcaattgatttcatcttgttttatagttttcattacagagctctttcacttttttggttaagttaattcctaggtatttaattttatgtgtggctattataaatgggattacttttttaaacttcattttcagattgtatgtagattttgtatcctgcaacttttctgaattttttaatcagtctaatagttttattctggagtctttagtttttttcaaatataaacaaggagatacatatatatatatatatatatatatatatatatatatatatatatatatatatatatagagagagagagagagagagagagagagagagaggcagagtttcgctctgtcacccaggctggagtgcagtggcttgatcttggctcactgcaacctttgcctcccaggttcaagcaattcttgtgcctcagcctcctgagtagctgggattacaggcgtgggccacaacacctagctaatttttgtatttttattcgagattagggtttcatcatgttggccaggctggtcttgaacttctggctttaagtgatctacccacctcagccttccaaagtgctgggattacaggtgtgagccaccaagcccagcctgatctttttagtgtattattgaactcagttttgaagtatttcgttgaggatttttgcatcaatattcaagagagatattggcctatagttttctttttttatttttttattttttttaattattattatactttaagttttagggtacatgtgcacaatgtgcaggttagttacgtatgtatacatgtgccatgctggtgtgctgcacccattaactcgtcctttagcattaggtatatctcccaatgctatccctcccccctccccccaccccacaacagtccccagagtgtgatgttacccttcctgtgtccaagtgttctcattgttcaattcccatctaagagtgagaacatgtggtgtttggttttttgtttttgcgatagtttactgagaatgatgatttccaatttcatccatgtccctacaaaggacatgaactcatcattttttatggctgcatagtattccatggtgtatatgtgccacattttcttaacccagtctatcattgttggacatttgggttggttccaagtctttgctattgtgaatagtgccacaataaacatacgtgtgcatgtgtctttaaagcagcatgatttatagtcctttgggcatataccgagtaatgggatggctaggtcaaatggtatttctagttctagatccctgagggatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcctcttttgagaagtgtctgttcatatcctttgccgactttttgatggggttgtttgtttttttcttgtaaatttgtttgagttcattgtagattctgaatattagccctttgtcagatgagtcggttgtgaaaattttctcccattttgtagcttgcctgtccactctgatggtagtttcttttgctgtgcagaagctctttagtttaattagatcccatttgtgaattttggcttttgttgccattgcttttggtgttttagacgtgaagtccttgcccatgcctatgtcctgaatggtaatgcctaggttttcttctagggtttttatgtttttaggtctaacgtttaagtctttaatccatcttgaattgatttttgtataaggtgtaaggaagggatccagtttcagctttctacatattaaaaggtattaaattaggaaaagaggaagtcaaattgtccctgtttgcagacgacatgattgtatatctagaaaaccccattgtctcagcccaaaatctccttaagctgataagcaacttcagcaaagtctcaggatataaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggatctcttcaaggagagctacaaaccactgctcaatgaaataaaacaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctacatcgccaagtcaatcctaagccaaaagaacaaagctggaggcatcatgctacctgacttcaaactatactacaaggctacagtaaccaaaacagcatggtactggtacaaaaacagagatatagatcaatggaacagaacagagccctcagaaataatgtcgcatatctacaactatctgatctttgacaaacctgagaaaaacaagcaatggggaaaggattccctatttaacaaatggtgctgggaaaactggctacttttcttttttttgatgtgactttttctggtttgggaatcagggtaataatagccttgtagaatgaggttggaagtattccttgtgcctcaatttatcagaatagtttgaataggattggtgttagtatttagttaaatttttcatagaattcagcactgaaaccatcagcttttctttactgggatactttttcttacggcttcaattttgttacttgttgttctgttcagggtttggatttcttccttgttcaatttttgtaggttgtatttgtctaggaatttgttcatttcttctagattttccaatttattggcatatagttgctcatagtagctactaatgatccttcgaatttctacagtgtcaattgtaatgcctcctttttcattttccatttaattgaatcttctctctttttttcagttagtctgcccataggttcgtcaatttggtttaacttttcaaaaaagcaactttctgtttcattgatcttttgttttgctttcttcatttcaaaataatttattactgcttttatatttttaattttcattttgttttgtttttgtttttgttattgttttgttttgttttgcaagacagagtttcactctcagtgcccaggctggagtgcaatggcacgatctcagttcactgcaacctccgcctcctgggttcaaagcgattctcctgcctcagcctccctagtggctgagattacaggtgtccgccaccatgcccagctaattttttgtatttttagtagagacggggtttcatcatgttggctaggctggtctcaaactcctgacctcaggtgatccacccgcctcggcctcccaaagtgctggggttacaggtgtgagccaccgcacccagcacatgtgtttttacagttcccaaaattccttatgttatggatttctaattttattccattgtgttcagagaggatgcttgatattatttcaattttagaaaacgttttaaaacttgttttgtgacctaacatatggtctattcttgagaatcatttatgtgctgaggaaaagaatgtgtattctgcagccgatgaatgaagtgttctgtaaatatctgttagaatcatttggtctatatagtgcagattaagtctaatgtttcttttttgattttctgtctggaagatctgtacaatgctgagagtggggtgttgaggtcttcagctatgactgtatggggacctatctgttgctttagccctagtaatatttgctttataaatccaggtgctccaggttgggtgcataaatgtttaacattgttaaagcatcttgctgaattggtgactttatgattatatagtaaccatctttgtctcttgttatagttttgtcttgaaatctattctgtctgatgtaagtatagctactcctgtgctttttcagtttccattggcatggaatatatatttccatccctttatgttcacgctatgtgtgtcttcataggtgaattgtatttctttcaggcaacagatcaatgggtcttgtattttttattattatacttcaagttctggggtatatgtgcaaaacatgtagattagttacataggtatacatgtgccatggtgctttgctgcacccgtcaaaccatcatctacattagatatttctcctaatgctatcccttccctagcgctccccaccccctgacagggcctagtgtgtgatgctcctctccctgtgtccatgtgttcaactccctcttatgagtgagaacatgcagtgtttggttttctgtgcttgtgttagtttgctgagaatgatgttttccagcttcatccatgtccctgcaaaggacatgaactcatccttttttatggctgcatagaattccatggtgtatatgcaccacatttttttaatccactctaccattggtggacatttgggttggttccaagtctttgctattgacaacagtgctacagtaaacatacaagtgcacgtgtctttataatagaatgatttataatcctttgggtatatacctagtaatgagattgctgggtcaaatggtgtttctagttctagatccttgaggaattgccacactggattccacaacggttgaactaatttacactctcaccaacagtgtaaaagtgttcctatttctccacatcctctccagcatctgttgtttcctcactttttaatgatcatcattctaactggcatgaaatggtatctcattgtggttttgatttgcatttctctcatgaccagtgatgataagcatttttgcatgtctgttggctgcataaattttgtcttttgagaagtgtctgttcatatcctttgcccattttttgatgggattgtttttttttcttgtaaatttgtttaagttctttgtagattctagatattagccctttgtcagatgagtagattgcaaaatttttctcccattctgtaggctgcctgttcgctctaatggtagcttcttttgctgtgcagaacctctttattttaattagatcccatttgtcaattttggcttttgttgccattgcttttggtgatttagtcatgaagtctttgcccatgcctatgtcctgaatggtattgcctaggttatcttctagggtttttatggttttaggtcttacatttaagcctttaatccatcttgaattaatttctgtataaggcgtaaggaagggatccagtttcagctttctgcatatggctagccagttctcccaacaccatttattaaataaagaatcctttcccaattgcttgtttttgtcatgtttgtcaaagatcagatggttgtaggtgtgtggtgttatttctgaggactctgttctgttccattggtctatatatctgttttggtaccagtaccatgctgtttttgttactgttgcctagtagtagtttgaagtcaggtaacgtgatgcacacagctttgttctttttgcttaggattgtcttggctatgcaggttcttttttggttccatatgaaagttcaagtaattttttccagttcagtgaagaaagtcaatggtagcttgatggggatagcattgaatctataaattactttgggcagtatggccattttcatgatattgattcttcctatccatgagcatggaatgtttttccatttgtttgtgtcctctcttatttccttgagcagtggtttgtagttctctttgaacaggtccttcacatcccctgtaagttggattcctaggtattttattctctttgtagcaattgtgaatgggagttcactcatgatttggctctgtgtttgtctgttattggtgtataggaatgctagtgatttttgcacatcgattttgtatcctgagactttgctgaagttgcttatcagcttaaggagattttgggctgagacgatggggttttctaaatatacaatcttgtcatctgcaaacagagacaatttgacttccttttttcctaattgaatatcttttatttctttctcttgcctgattgccctagccagaacttccaatactatgtggaataggagtggtgagagagggcatccttgtcttgtgccggttttcaaagggaatgcttctagtttttgcccacttagtatgatattggctgtgggtttgtcataaatagatcttattatttttagaaatgttccatcaatacctagtatattgagcgtttttggcatgaagctaaatatcttttctgtatcaatttaaataatcacgtggtttttgtctttggttctgtttatgtgatggattatgtttattgatttgcttatgttgagccatccttgcctcccagggatgaagccaacttgatcatggtggataagctttttgatatgctgctggatttggtttgccagtattttattgaggatttttgcattgatgttcactaagggtactgtcctataattttctattttgctgtgtctctgcaggttttggtatcaggatgatgctgacctcataagatgagttagggaggattccctttttttctattgtttggaatagtttcagaaggaatggtaccagctcctctttgtacctctagtagaatttggctgtgagtccgtctggtcctggacttcttttggtttgtaggctatgaattgctgccccaatttctgagcttgttattggtctattcagggatttgacttcttcctggtttagtcttgggagggtgtatgtgtcctggaacttatccatttcttctagatttcctagcttattggcgtagaggtgtttatagtattctctgatgttagcttgtatttctgtgggatcggtggtgatatcccctttatcattttttattgtgtctatttgattcttctctcttttcttctttattagtctgactagcagtctatctattttgttgatcttttcaaaaaactagctccttgattcattgattttttgaagggttttttatgtctctatctccatcagttctgctctggtgttagttatttcttgtcttctgctagcttttgaatgtgtttgctcttgtttcttttgttcttttagttgtgatgttagggtgttgattttagatctttctttctttctcttgtgagcatttggagctataaatttccctctacacactgctttaaatgtgtcccagagattctggtacattgtgcctttgttccccttggttttaaagaacatctttatttctgccctcatttcattatttacccagtagtcattcaggagctggttgttccgtttccatgtagttgtgcagttttgagtgagtttctcaatcctgagttataatttgatttcactgtggtctgagagactgttatgattttcattcttttgcctttgctgaggagtgttttacttccaattatgtggtcaattttagaataagtgtgatgtggtgctgagaagaatgtgtattctgttgatttgtggtggagagttctgtagatgtcttttaggtccacttggtccagagctgagttcacatcctggatatccttgttaatttctgtctcattgatctgtctattgttgacagcggggtgttaaagtctctcactactattgtgtgagagtctaagtctctttgtaggtctctgagaacttgctctatcaatctgggtgctcctgttttgggtgcatatatatttaggatagttagctcttcttgttgcatttatccctttaccactatataatgctcctctttgtctgttttgatctttgttgatttaaagtctgttttatcagagactaggattgcaacctctgcttttttttaatttccatttgcttcgtaaatattcctccatccctttattttgagcctatgtttgtctttgcacatgagatgggtctcctgaatacagcacacagatgggtcttgactctttaaccaattcttcagcctgtgtcttttaatttgcccatttagctgatttacatttaaggttaatattgttatgtgtcaatttgatcctgtcattatgatgctagctggttattttgccaattagttgatgcagtttcttcatagcgtcgatggtctttacaatttggtatgtttttgcagtggctggcactcgttgttcctttccatgtttagtacttccttccagagcttttgtaaggcaggcctggtggtgacaatatctcagcatttgcttgtctgaaaggattttatttctctttcacttatgaagcttactgtggctggatatgaaattctgggttgaaaattcttttctttaagaatgttgaatactggtccccactctcttctggcttttagggtttctgctgagagatctgctgttagtgtgatgggttccccttgtgggtaacctgacctttctctctaaggtctggctgccattaacatttttttcttcatttcaaccttggtgaatctgatgattatgtatctggggttgctcttcttgaggaaaatgtttgtgttgttcgctgtatttcctgaatttgaatgttgacctgtctttctagattggggaagttctcccggataatatccttaagagtgtttccaacttggttccattctccccgtcactttcaggtgcaccaatcaaacgtagatttggcctttccatatagtcccatatttcttggaggctgtgttcatttcttttcactcttttttctctaatcttgtctttttgctttatttcattgagttgatctttgatctctggtatcatttcttccacttgatcgatttggcaattgatacttttgtatgcttcaagaagttcttgtgctatgtttttcagctccatcaggtcatttatgttcttctctaaactggttattctagttagcaattcatctaaccttttttcaaggttcctagcttccttggattgggttagaacatgctcctttagctcaaaggagtttgttattacccaccttctgaagcctgcttctgtcaattcatcaaactcattctccatccagttttgttctcttactggcaaaacgttgtgcctttggaggaggagaggtgttctgcgttttgaaattttcaacctttttgtgctggtttttcctcatcttcgtggatttatctacctttggtctttgatgttggtgactttcaaatggggtttctgtgtgtagatcctttttgttgatgttgatgctattcctttctgtttgttaattttccttctaacagtccgactcgtctgctgcaggtctgctggagtttgctggaggtccactccagaccctgtttgcctgggtatcaccagtggaggttgcagaacagcaaagattgctgcctgttccttcctctggaagcttcgtcctggaggccacctgccagatgccagtgagagctctcctgtatagatgtctgtcggcctctactgggggatgtcttccagtcaggatacacgggggttagggacccacctgaggaggcagcctgtcccttatcagagctcaaacactgttctgggagatcagatgctcttttaagagctgtcatgcagggacgtttaagtctcctgaagctgtgcccacagctgttccttcccccaagtgctctgtcccaaggagaagggggttttatctatatgtccctgacttgggcggctgcctttttttcagagatgacctgccaagagaggaaatatctagagaggcagcctggccacagcagccttgctgagctgtggtgggctctgcccagttcaaacttccatgtggctttgtttacatggtgagggtaaaactgtctactcaagcctcagcaatggtggacgctcctccccccaccaagcttgagcatcccaggtggatttcagactgctaacagtgagaatttcaagccagtggatcttagcttgctctgctccatgggagtgggacccaccaagccaggcaccagagggaatctcctgatctgccagttgtgaagaccatgcgaaaagcacagaatctgggccggagtgcactgttgttccgggtacagtctctcacagctccctttggctaggaaagggaaatcccctgaccccttgcatttcccgggtgaggcaatgccccattctgctttggctcaccctgcatgggctgcattcactgtccaaccagtcccaatgagatgaactggatacctctgttggaaatgcagaaatcacctgccttctgcatcaatctcgctgggaactgcagacaagagctgttcctattcagccaccttgccagcaagtcccctggttcttgttttttcattcattcagccactccatgtcttttgatgggagagtttagtccattgatattcagtgttattattgataagtaaagactcaccctgccattttgttatttgttttctggttgtttcttggtgttctcttctttctttctctcctttctgtcttcctttagtgaaggtgattttctcttctgatataattaagtttcttgtttcttattttttgtgtatccattgtatttttttgtttgaagttatcatgaggcttgcaaatactatgtaatatccaatcgctttaagctgataatagcttaatgttgtttgcatcaacaaataaacaattaaaaaaactaataaaaactttacaccttaacttcattcccttgctttttagcttattgttgcctctatttacatcttattgtattgtctatgtcttgaaaagttgtcatagtcattattttttattgattcatcatttagtctttctatttagcaagagtagtatacacaccacagttatggtgttataatattgtgtgtgtttctgtttacttactatgaccagtgagatatgtaccttcaggtgattacttattgttcattaacatccttttctttctgattgaagtactccctttagcatttcttgtgggacatgtctggtgttgaaatcactcatcttttgtttttctggaaaaatctttatttctccttcatacttaaaggatatttttactggataggctattctaggataaaagtttttttttccttcagtactttgaatatgtcatgtcaatctctcctggcatgtcaggtttccactgaaaaatctgctgcaagatttattggagctccactgtattaaatatgttatctgtttattttctcttgctgcctttaggattctttcttcatcctttgtatttgggagtttgactattaaatgcctgaggtagtcttctttgagttaaatctgcttggtgttgtataaccttcttctgcttagatattaatacctttctcttggtttcagaagttctatgatattatccctttgaatcaattttctaccccctatctctttctctgcctcctccttaaagtcaataactctcagatttgcccttttggggctgttttctagatcctgaggatgtgctttttggttatttattctttttttcctttgtctcctcttactgtataattttgaataccctgtcctcaaattcactaattgtttcttctggttgatcagttctgctattaaaagactttgatatgttcttcagtataccaattgcatttctcagcttcagaatttatgctggaaaccttttaattacttcagtctgttaaatttatctgatagaattctgaattccttctctgtgttatcttaaatttctttggcttcctcaacacagctactattttgaattctctgtcctaaagttcacatatagatatgtttctccaggattggtccctgattccttatttagttcatttggggaggtcatgttttcctgggtgctgttgatgctaatagatgttatttagtgtctgggcattgaagagtttggtatttattgttgtcttcattgtctgggcttgtttgcacccatccttctttggaaggctttccagatattcaaaagtacttgggtgctgtgttccaagctgtatctgttttgggatgcttccaaagcccactaacactttggttcctgaaaactagtaaaagtacctccttgatgaccttgggcaagaactgggagaatattctgtgctaccaggcagagacacttgttttcttcccttactttctcctaaacaaaagtagtctctctctctctctctttctctctctctctctctctctctctctctgttttgcatcacttgaagctggggatggagcgaaataagcattcttgtggccactgccactataactgagctgggtcagacttgtagccagcacagcactgggtctctcccaaagcttgcaataaccactcccttgctactgcctatgttcatttaaggccctagggttctacagtcagcagatggcaaggccagccagacctgtgtccttccctgcagggtgaagacttcccccaggcactgggtgaatccagaggtgctatctgggagtcagggactagattcaaaaaccatggaagcctacctggtattctattatactgtgactgaactggcactcaaaccataagatgcagtccttcccactcttccctctccttttcaaaggcagaggagcctctcctggtagctaccaccatcccaggccatggggagttctgccagactaccactgatgttctcttaaggcccacgggctcttcagtcagcttgtgatgaatgctgcctggcctgagactcacccttcagggcagtgggctcccctctgacccagggcaagtccagagatgctgactaagagtcaagtcctgaaatcagggatcccaggggactgcttgatgcactatccccccgtggccatgctggtaactaaggtgcaagacaaaattccctttacttttccatctgcttttctcaagcagaaggagttttgcactgtatccaccagagctggtcatatgctgaatctcacctgaaggcagaaagtctcagaggctcacccaaggccttgacgtagtaccaggtaatcgttactggttgtttagggacaaagggcttttcagttagtgggtaatgaatgctgacagactgagtctgtctttttttttttttttttttttttttgagacagagtctcgctctgtcgccaaggctggagtgcagtggcgcgatctcgcctcactgcaagctcccccttccgggttcacgccattctcctgcctcagcctcccgagtagctgggactacaggcgcccgccaccatgcctggctaattttttgtatttttagcagagacggggtttcaccttgttagccaggatggtctcaatctcctgacctcgtgatccgcccgcctcggcctcccaaaatgctgggattacaggcgtgagtcaccgcacgcggccctgagtccttccttttaaggcagcaggttcccttctggctcaaggtatgtctggaaatgttatctgggaactagggcctgaaacagtgacctcacaactctggtgccctttcctgctgtgactgagctggtatccaagatacaagacaaagtcctcctcattctttcctctcctctcctcatgcggaaagaagaggtctcttttaagactgccagctatgcagcctggggttaggggagggctgatgccaatattcccttgactgctccagctggtgtctcagtaggttgcaagctacccagtccactgtctctgggctcaattcagccctgggacttgcctaagagttgcaatccttatgtcatagactgtctttcaagtttacttgcagacataggttgctggagccctccgtgatgaggtttgcaggaaatcaagtcttgaccactaggatccacaattcccctctgactagggctggtttaaatgctccctctgtggacaggcatcagctgagtttggttcagttctcctttctgctataacggaatagcactgagttcagtgcctcactgttgctgtactcttcctcctgcagtgtggagttgctccctgcactgtgcagcttctgctggggtagtggcagaggggtagtattagcgattcgagactgcttttactatctcttcagcgcctctttcagcaatacagagttaaaaccaggtactgtgacagctcacctgatttttgcttcttatgaagatgtttttttttttctgtgtagatagttgttaaattactgtccttgcggggaagataattgatggagcttcccattctgccatcttactctgcctctttgtgagttagtttttaagataaggtgtaagttaaggtcaaggttcatcgttgcctatgggtatccagttgttctagtatcatttattgaaaagactacccttcattgatttgtgtttgcacctttaccaaaagtcagttgcctatgcacctattcttctgccaaaccacactgctttgattactgtggctatagtaaaccttaacatgatatgaagtgattcttcctgctttgttcttctttttgaaattgctttagctattctagaacctgtgcattttcatagaaattttagaatatgtctatgtttatgtctatgtctacaaaagcttgaaattttaataagaattacattaaatctatagaccaattcagagagaattgacatcttttatatactgagtttttcattctgtgagcgtgatatgtctctccatttctttttttatgttcttcatcagtagtttataattttaagcatatagaacttgtacatattttaagtatatacctaaatattttattttctttctaacaattgtaaatgatattgtgcttttaattttattttccacctgttcatagtatatagaagtgaaattaacttttgtatgttgatttcgtatcttccaaacttactgaacacacttattagttctagaggtttttttatagacttcaatggattttctatgtaaacaatcatatcatctgcaaatagggacaattttattcctttccttccaactgcataccttttatttctttttcttgtcttattgtgctgactaaaacttcccgcacagtgttaagaaagagtggtgagagcacacatctttcccagttttagggggaaagcattcagtctttcaccatttaatatgatgttaacaataggattttttacatgttctttatcaagttgaagtaatttctctctattgctaactggctcagagtttttatcatcaatatctgtggaattttgtcaaatgtgccttccatatatgttaatatgatcacgatttttcttctttcacctgttgataaatattgcacctactatgtacccacaaacaattaaaaataaaaaaattaaaatgatggattactttaattgagccaaatgttcaaccagtcttgcatacctggaataaatcacactttgtcattgtatgtaatttcttttatacattgttggattaggtttgccaaagttttatcaaaaatttctacttctaagttcttgatagatattggtctgtatttttcttattttatactatctttgtctggttttggtagcagggtaatactggccttgtaaaattaggaaatgttatatctttgaatttttggaaggcatcatgtagaatttattttaattatgttttaagtgtttagtagcagggattattcatcgtggttgagattttagagtgtgtgatttttaggaaactggtccatttcttataactggtaaaatttatgagtgtaaagttattcatattcctcccttattaccctttcattaactgcaagatctgtagtgctatctcctgtttcattccccatattggttacttgtgcaatctgtttttgtttttgtcagccttgctagaggtttatcaagcttataatttgtttgagaatcagcttttaattgtatcaattttctccaatgtttttctgttttcgacttcattgatttctccctttctctgtattatttcataatctttctgcatgctttgtgtttgtcttttttcttttttctagcttgttgaaagtattagaatattaatttgagacttgcttcttgtttaatgtaatgatttcatgctatgaacttctctctgagcactgctttagctgtatctcctatattttgatatgtttgttttattgttattttccttagagactttctctttgactgatgggctatataaaggtgttttgtttaattttgaagtatttggatattttcctgttttgttttattattgatttctaatttgatttcattattgtcagagaacatatctgtatcatttcaattattttatatgtattgaggtgtcttatgatgctgggtatggtatatcttgatgaatgttcaatgaatgcttaaaaatgtgtgttctgctgttctcatgtggagtgttatatctatataaattagatcctgttggtttattgtattgttcagctcctttatatctttgatgactttctatctagtagttctatcagttgctatgaagaatatgtgaaagtccccaactatacagatccacaagtatagctggggacttcaacatactatttctccctttgggtctatcagattttgcttcatgcatttgcttcatttatttgttttggggcactattgtttaatccatgcacatttaggatcattatgtcttcagggtgaattgatccttttatcattatttaaagtccctctatctctagtaatttatttgccctgaagttgattggatactatgtattaattcctacctttttaaaattagtatttacttggtgtgtctttttccattcttttatgtttaacctacccctgttactgaagttgacaagtgtttcttgcaaacagtatatcattgggtaatgtttgtttgtttccttccagtctctgtcttttgattcctgtatttagactgtttacatttaaggttattattgatatgttagaacttaagtctgccattttattatttgttttccgtttgtttcctctggctctcattcctctatttctcttttcttgccttcctgttggttacttgaacatattttagaattctatcttgagtcatttatagtgtttttgtttttgagtgcatattttgtatagttttcatagaggttgctgtaggtattacaatacacatatgtgacttatcacagtctcctggtttcaacattttaccacttttagtatagtggggaaaccatacttacattaaggtccctttacctttcccactttttaaatactattgcctttaacatcagataatgctattttttgtttcaatcatcaactataatttataaactataaactcacaaggaaaaagggaatttattgcacttacccacatttatttttaacagctttagtaagaaatcatacagataccatataattcactcatttaaagtgtaaaattcgatgtttttagtataacagggttatgcaacattcaccctgccttagtttatttctgttgctataacaaaatacctgagactgagtacattatcaagacaagaaatttacttagctcacagttctggaggctggaaaattcaagatcaggtggctgcatctggtgagagccttgtgctgcttcatagtttagcagaaaagtggaaggggaattggttatgtgctaagagagaggagacaaaggaggctgacccgttttataacacaacctgtttttgcaggaactgattcagtttcatgaggactaacccagtctcctgagaaagagggtaatccatcttaatgacctaatcaccacttaaaggccccacctctcaacatggttacaatggcattaaatttcaacatgagttatggcagggagaaaacacatccaaaacatagcacactacaattatttttagaatattgttccctctagaaataaatcccatatccattagcagttactcttcattcccccaaattctccctccctgccagccccaggcaaccaccaagatattttttgtctctattgatttgcctgatctggatatttcacatatatgaaataaaatcatttgtagtcactttgttactgggttctttcacttagtataatgtttttgaggtagcatgtatcactatcttattcctttctactgctgaaaaatattcagttgtactgatacactaccttttacttacccatttatccattggtggacatttgggttctttctacttggctataataaataatgcctatacaaacatctgtgtataagtttttatgtgcatgtaagcttttatttctatttgttatgaatctaggagtggaattactgagtcatatcaaatcctttccccatttataaattgggttgtttgtctttttcttattgagatgtgagagttctttatatattctggataaaattcccttgttgtacatattacttgtaaatattttcacattatatgggttgtcttttaactttactgatgatattgcttgcagcacaaaatatttaaaatcgatgaagtccaatttatctgtttttcttttattgagtgtgctcttggtgtcatatttaagaaaccataggctaactcaaagtcatgaagacttactcttatgttttattataagagttttattgttttcactcttacatttaggtctgtcatctattttgagttgattttttgtgtgtatgatgtgaagaagttcactcaatttcatttgtttgtatgctggttttcactcttccagtgtcatttgttgaaaagactattttttgctctatggaattctctttgaacttttgttgaaaatcaggtgaccacaaatgtaattgtgtctttgtggattctgagttctattccattgatccacaagtctcgccctatgccactatctgtcttaatgatgctttgtaatgagttttgaaactgagaattctgagtccttcaactttatttttattttccaagggtactttgactggtctgtgtccctttaatttaatttccacataaatgtatcgatgtgttaaactgcagatacattgggggagggagttggggagaatgtgaagtgactaccaatgggcaagggatttctttagtgggtggtttaaatgttctaaaatctattgtggtgatggttgcacaattctggatatacacaaaaacatactgaactgtacactttaaatgagttcagtgtatggcatgtaaattatatctcaataaagcttattaatgaaataaatctaataatgaaatgtgaagctctcatcacaaatttaaaataattaagtaattaaagaagccaaatattatatccaaaactcattggaacactcaagttcaatatgaaatcaaatgatagtgtccaaactcatcatgaagggcctaaactggctataatcgatgtttgtaaccaaaattgagaaatggcagtacagtacatagcatgatttctaacagaccaaaattcagtagtcagctatgtttaaattagaaaagttttgtaatattcataaccactgttttctagtgtcactctttttttgctagatctaaatgtattcatagtttcatcattaataaattcgttcatttattgtactcctggaaaacaaacaagtatttttatgctcattataataaaaacataatggaaattcaatttactaaaaacctaaacctcttcatatttaaaaatttatttgaaacattgaagtaattgctaacaaaaacctaaagaagctatcaagttaaaaagataactttttatacttctattttaagtttaggggtacaggtgcaggtttgttacataggcaaatgtgtgtcatggaggtttgttgaagagattattttatcacacgggtattaagcctagtacccattagttatttttcctgatcctctccctcctcccacccttcaccctctaataggtcccagtgtgtgttgttcccctcttgtatgcccatgtgttctcatcatttagctcccacgtataagtgagaacatgtggtatttggttttctgttcctgggttagttttctaagcataatggcctccagctccatacatgtccctgcaaaggacattatttcattcttttttatggctgcatagtagtccatggtgtatttgtgccacattttctttatcccatctatgattgatgaacatctaggttgattccatgtctttgctgttgtgaatagtgctgcaattaacaaatgtttgcaggtgtctttataatagaatgatttacattcctttggttatatacacagtaataggattgctgggtcgaatggtacttccgtctttagtaggtctttgaggaattgtcacactgtcttccacaatggttgaactaatttatactctcataaacactgtataagcgttcctttttctccacaacctcacagcatctgttattttttttgatttcgtaataattgttattctgactggtgtgacatggtatctcattgtggttttgatttgcatttctctaatgataggtgatgttgagctttttttaatgtgattgttggccactatatttcttcttttgagaattgtctgttcatgtcctttgcccactttttaatggtgttgttttatttcttctaaatttatttaagttccttgcagatgctggatattagacctttgtcagatgcatagtttgcaattttttcccattctgtaggttgtctgtctactctattggtggtgtttgtttgtttatttgttttgttgtgtggaagctctttagtttaattaaatcccacttgtcaatttttgcttttgttgggattgcttttggtgtctttgttgtaaaatctttgcctgttcctatttcaaggatgtcattgcctatgttgtcttttagggtttttgtagtcttgggtattacatttaagtctttatccatcttgagttaatttttctatatgatataaggaaggggtccagtttcagtcttctgagtatcgctagcaagttatcccagcaccatttattgaacacggaatcctttccctattgattgttcttgtcaggtttgtcaaagatcagatatttttagttgtgcagtcttatttctgggttctgtattctattccattggtctatgccagtaccatgctgtttggttatttagccctgtagtatagtttgaagtcgggtagcatgatgcctccagctttgttctttttgcttaggattgccttggctattgggtgttttttggttccatatgaattttaaaatagttttgttctagttctgtgaagaatgtgaattgtaatttaatgggaatagcattgaatctacaaattgctttggacagtatggccattttaacgatagtgattcttcctttccatgatcatggggtgtttttccatttgttcgtttcatctctgatttctttgagcagtggtttgtagttctccttgtaaagatctttcacctccccagtttgctctagtcctaggtattttgttgtttttgtggcaactgtaaatgaaagtttattcatgacaggtcttggcttgactgttgttggtgtataataatgctagcgatttttgcacattgattttgcatcctgagactttgctgaagttgcttatcagtttaagtagctttttggctgagatgatggggtttttgagagatagaatcatgtcacctgcaaacaaggatagtttgacttcctctcttcctatttgaatgccctttatttctttctcttgcctgattgccttggccagaacttctaatactatgttgaataggagtggtgagatggggcatctttgtcttgtgccagttttcaaggggaataattccagcttttgtccattcagtgtgatgtaggctgtgagtttgtcatatatgtttcttattctttgaggtaagttcattcaatacttagcttattgagagtttttaacacgaagggataaagataattttaatttttcatatgtcagtgaaattatgtgacatacacatgatggtacatatgccatatattcgccagtcttgtcaacattttaagcaaggaggctaaattattccacagatcagctgaatgattcatatctgcccttgtttgcctaaaatggaagctgcaaggtcatattttctattcatcctggatactcataaagtccttttcaatccccacacaggtcctttgcaggggttcacctgactatactcaatgcagtgttccacttctctgtagtcaagaaagaaaaacgaaatgtcatccattcaccactgcctaagaaagacatagcctaaatggacagcaaatgtccagttatataaaaaacccacacagctgcactgagccctgggaataatgccagtattgctaatagagcaatgcttctcaatgtgtggatacactaccattggtggtccacaagaaaatttgcggggacacactggcaaatgttttaatagttatgtatttgttttcttgtgtactaagaaaaataaatacttagcacacaaaatctgtgttctcaaaaatattactttttgaggatgggtaaaaattatggtattattagtaattcctttacttagaatgctcatccatctctcttgtttgtctttgcctcatgagtaagttcttccctgacccaactttcagacagttttagttggttctccctctggtccccataatgtttttcacatatctcatttatatcacatttcagattacagtgtaatttttataagcacacttatttttattagagtgtgagcttctcaagaatcagagtcaaatctttgtatccttagagcctgatacagaggttggacccttgtagtgctcaattaatatttgtggaattaatgcatatgaattacaactgtggtcaggataattacgttctacaagcattgatctagtagctatttctcagttggaggcacgatggcagggtatctcagggagaactgaaaatttaaaactacaagacaggaaaccaagcataattaattctctatttgattaattacattagcaaaattttatatgctgagttttcttataataatagatttctgatctaagattcaaaagcagaattactgaaaagaaataaaggttgaaagaactgaagtttaattaagagagcagaggctctggaatcaaactgttctgagtttgaattcttactcaacaattactagctttatcatctgtatactgaggaccagagataattcatatgaagcctaacaaagtactttatacatggtaagatcctgataagtgcaagctgttattattaatttaaagcatatcttactaattacatacaactagtaattctgtgaggtctagcctaagagaaaaatataaagaagtccagttctcccctcttactttgttaccattcttactccaaccctctctcatgatagcattatgatcattaccttccagacttatgccaaccaccagtttaaagcacacctggtctctctctccaaagttcctggtataaatcttccctatacaaggaaataaatcattttctaattcatactttcctggtggcaaggagataattgtttaaatttaaaaagttttttcatctaatttctactgggttagagtaaatcagaatgctgtcaagccaggaaagtacttaattaagtagagaaggtgacaatgagtcagcgtactttgttggaaaaattacaggccaaaagtttaagtaggagaccagatttctagtctctactttgctaataactcacttagaaactttaggtgagttgtttaactgctctagcctcaacttcgttacctgaagatggtaagttctatgccgccaagacactggcttatattttcaaaaaaataaggctgtatcccccactcactcctgaaaccaaaataaattccagaggactgaacaaatatttaactataaaatgtcaaactatataatttataaagagaagtgtaaatggatttgtttatacctgtggaatagagaaactcttctaaaggaaaacacaaccagaagtaataaaggaaaataataagactacataaaagcttaagtcttctctctagaaaaaaatatcactattaagagctgaaagaatgaaagagaaaatccagtagaaaaagaaaggatatggtcgaaaaattcacagacaggaaatacaaatggtcatcaaacatatgaaaaaatgttcagcttcactcgtaattaaagatatgcaaatcaaaaaaagccatttcaatctattcaatttttaaaaatgaataatttttcaggtaccaaatgctgtaatgtcaaagtgagcatgcttctgtgtcagagtataaattggtgctgctctccagtgccagttcttgccacctgtctctgaagtacttctttcccaatcattctcagagatgaccctcttccactattcctattttctgatttggcgtcccacagccactttatagtctgggacactatgtgcaaataggtacttttttccatcacacatcatgtcacctcctctgctttctggaaagttcaaagttccttcaatatggctctttttctctctcctactctttggagtctcttctctaataaataagttctacaaatttcaagaacctagccagtgtaattttcaaatggtcattagcagttggctgcctggaagaaacgaagacttgagtaagctcttaaaatgtaaacaaagcaaaaattaatattcaagacattaatcttaccacagttattttaaagatgaaattaagataaccaaatacaatagaatgctacatttattgacaaaaattagcataaactcacaaaacaatgtttctgttttcaagagctatacaaatattaatatttttcacagagcaaaacccatctcacaaaccaaaaaagcatgaaccatatatattttattaccttttttatctccagtgtgggccttattcagaagaaattaagtgctaaatggtatccaatcttacaataaatttagaagtaaactagaacataaaaacaaataggaaactgaaggagtaattatattttcccttaaacatgaattgatcatgtgtctgtatatgaagtagactaaacaatatatatattccaacaagtaaactatttagagagcatatttttaaaaatattatcttatttccacttaggcaatttaaccctgaaaccaagggaaggagttccaaagatatgcttagtttattggaaataatgaaaatatgtaaatgtggatttatactatcgtcattaaaatttgtgagaattgagcatgtccatttgcttgaattgttactcatttcaatataaaatataatctttttaggttttgagtaggtgtaaatgattgaagcatgtcagctattgtttaacaaaggaagtgagcatagactgaataaaaaacggatagaaataaacaaacaaaaaagaatgattccttgaaaaacaagtaaatgtgagaatgtcaccatgtccttagaaggtaagaacacacacacacagacagacacacacacacacatatatatgatgcctccaaatatgactcttaagacataaattttaacgattcctccttagtgaatctccctttctttcttccttcctgtactctagctttgctgtgcattctagagcattttaaaatttaatacctttgttgaagagccatttgtccttttatcctcttaaaggactatacagttaatgttagcaatagcaaagattgccaattccccatacaagaaaatctacttgagctctgctacttcatcagagtgttcatatctacactttgaggattaaagacaactagttttaacatcattttatctcaccttaaatgtgtctaagttaaagcaagctccagttgatggcccatgtgtttcaaataatttacaacaaaacgaaacaattcgtaggttatatgaagcttgttataaaatgataagtaaggctctaagtgaatggataaagcccaaaacaggaaaaggaaaaaaaaaatcctagcataacacaaactgaagaaaatcaattgttacagacatctaaaaaatcgcatttaactttagcttttggttaaaatgccatcagtttactaaattgaatatttttcttaataaagatgttggtttctaacacacaacctatttgacaggtcaccactattctctcatgaagggtgattatttctaatcaaccctcactagtgaacagttggactacaccgaaaactgatctattcttgaaaataggctcttgtctcatataggcagcctggggcatttatcagttcttgaattcttgtttcatttctttttgtaagagtaaccagcattagtgaactttctaaggagaaaaagcctgaacattaaggccaattaaaataaacaaagtgaaaatataattgctttaaactaaagatgtcattttttcaatgtgccacaatagccgcaaaactttagaagtgtcacaatctacatttccatattttaaaagctatgaattaatatctgtgcttctataagttgaggatgaaggttaaacgttcctatcatattaagattttaaaagtctatttcatgcaaaaaaacatagatatcaactataccaaaagtataaattaagttcaatagataggatttagtaaataccctagaaattttctaagagagtagatattaggtgctcttaccacaaaacaataatttttttgttgttgaatatgttgacttgcttgaccgtagtaatcatttcattatatgtatatcaaaacatcatgttgtacatcttaatatatacaattaatcttttaattttaaacaataactatgtatataaataaatttaagggaagctgaaatcttataaagtaagaaagtttgaaactcttttcaagtaaatgatgacacctactggatgttagaaatcttcaaataacatttaaccaataatgaatctcatccgcaatttttatctgaaaacctctttgctggcaagggaaagaagaaaacatgggcaagcatttggacgttcaagattaaaaactcacattcaccagacttactttagaccaaaaaacaaataaaggaataaggtaaaaagtagtttttctcttctgaattttctactttcttgaggtatagaaaactgactagagaatacaagtttaagatcatagatgagtgaggatccaatgaatcagtaaaaagatatatctgaagtaggttgacagccagagtttcatcttgagttttaaggtcattgagatggaacataattcgtgtttaccaaatgtgtcatttagtcattaacatttctgtataaactgtgtaattgctgatatcacaaccgtagataaaatttttagtaaaaaagtgaaaaaaactgcctgattttttttttttttttttttttttgagactgcgtcttgctctgtcacccaggctggagtgcagtggcatgatctcggctcattgcaacctctgcctcccaggttcaagcgattctcctgccgcagcctcccaagtagctgagattacaggcatccaccaccacaccccgctaatttttgtatttttggtagagatggggtttcaccatgttggccatgttgatctcgaactcttcacctcaggtgatccacccgcctcagcgtcccaaagagctgggattacagacgcgagccaccacacccagccaactgcttaaattttaatagatgatctttcgcaagtcatttaagctctctgggcttgtgtttattcatctgtattccaagggtattgaaactagaaaatctctattagtatctgctaaacttgaatgtctgaaagcctaaaaatagcattcttttaaattgttactttaaaagtcggtagaaattttacaaatagaaacataaaatgtattatattccttttacccctagaaagcagctcaatttacttttaccactggaaaaataatctatctgtcatatcagtggctactctttaattcagtattttattagtctttggcctgctgcaaataaacataggacataggaagatttgggtcaccagaattacagtttttccagagtcagtctcagctaagtggcatcatcaattcaaataaatttctgatatcaatcttaaacaaggctcagaaataagtgtattgatgtatttggctcactgtagacttggatttattttaccctctgaaaataccaacaaaaaaaatctaaaacactgtattctaataatatgatagaattcttgcattatttgctgacaatagtatatagttttccaattttttattttattaaaatacaacaggaataataatggtgttgcatgaggtcaaaattagagatattttaacagagaaaataaagtatttcttactagtcaatcagtatttttgagatcccattgcatgcaaagtagtgtatctagaatgcttttaattaatcatatatatatataattttaaactatgaatatacagaacatttgaagacctgttttatcttggctgtttagcattccttttctcataaatacataatattttcttttggattctctgtcaatatatcttaatgttggtgcctttaatccataaattttcatatcttcctgtgtcatttttaactggttactaaatggacacgttacagttcctgtaaattttgggagtggtagtaggcatgcttaatagccaggtaaaattagggaattctgtggagaattgtcaggcaatcaattttcctagtcattaataaattaaaaagagaaacaagccaacgtaatcttagaaaaaaatagtccagtaaaaagtctcactttgacaattacacaaaaataacctttttactctggaataatttatcaattttagaaaaatatattggaaaagtagtaaattctacagaaggtatgtagagtgtgatgtgctgagtaaatatttaggcaaaaggaaataagtatatacaagtttgacccaatttgaagaagtttgatggagtggttgggaaaaaaaggaaaaatcaagcttgcttgtgtcctatgagtagtacaatctaaattgtatagtataacagcagggaagaatttcttagggctaaaataattgaagaaggcttttgtcaaagaggtgatatttggattgggtctaaacagtttggtaaacatttgataggtgaagatatttgagaatggggctgcagtcagaggtaataatactgcaaaggcaaagagcctaaacaggtttgctaatgtaaaggaccgctctggttaatggttagaaggaagaacatgaggaaatgggggattggggtcaagaaacagaagaatgtttcacacttagaaaatgttcttttgcatgcatgactattttttcaatttaataagatataaatcacagttgcaacacgttagccttcaagaagaaaaaactggccaaaaaagaaaattgctgacaaatttaagaggagttttagagctcactgacctgcacattatgctttgcttctctaagctttaccttccaaggctcctcaagataatttgtttcaatccacttggactaggcactatgttccctgaacaagtacaaccttttcctgccgctgcatttgctgtaatgtaacagtctaccgaactgttcacaggcaagccaaattccacttcctcaatcaaaccctttgccaagttaccttagtcctaaaagatccttccctcctgttttattattgaatttagattgcaccattcagataatacaatcagctttgatttgtaaataggtatgcatctgtttgctcaatcctacaaaattataaaattccttaaagacagaagctgtgtaatgcaactttgcatgctacagggtttcgcattttcataagctagtctacaaaaacaaaatccgactcacaaaataatgctaaataagaatttgttgaatggatgcattccactgctgacacattttcattcccttcatttttcttcttatccttatgaggcaatccttatattaaaatcaatttttatgcttatcttctaactgttggagaataaaatgattgaaacatatttaagttcacccaggaatgcttttaccataagggcaaaaagtgacatcaggaacatctagggattatcccaataactgtggacgaaggaagcaatttaaatatctttctgatttacttacttgaattagaatgcagtatgaagttgggggaaggaaactgagcagcagtcacgcaggctcattctacctgatctatgtaattccatactatcagtgctggggaagaatgggcaataataataataataatgatataaatatataacaaaataaaaataatatagcaatagtaaatataataattacaatgggttattctgttaggctgtatttttgcttgaagggatggtttggcactctgtagcagatacagtgtttatctcttaaactgattattccaaattttttaacctacataaacacaaatgaattcttcctaaagtaactgttcaaaaggttaaatttcttttttgattaaccctccaggataaggatttgggttgttgtttgggagcacttttatacacaggtagctcttacaacaaccacatcaaggcgcctctgagaaagggcggtggggaattagatcctctattttaatcatatttattcccaagtaatttattcatcaatctccacctcaaccctgaaaactttaggtctcagaaactgacactgaaaggcacctataagcctctcttacagtcgaaagtcacctaaatatggctgggactagagtgacgctatggagacattctcctttggcaaaaattttaaagggccgcctagaaactcagtaatgaagatacttaatatttttagacaatctttttaaatatcaaaattcttgcaaaaaagtccatgatgaacaaaatatcaaaaatttaaataaagacaggatcataccctgcacttgcgtgactcacctcactcgcctcatcctagtctcctgggtttttgtcacaagcttaaattttgtgcctgaggcgagtacctcaatggctttatgctagtctaggttctgagtcctaaacactttcgtggatagcaccttcttgagtcctttcactaaatgcaaccttcagattaaaaatctattctcagtgtttttcatttggatagacctctgctattacacatttccctcggagtcccgctgaattcttcgtatacctcctccaagtgggataacggtatagctcccggttttgtcgctactctacacctgcggaaaacacgccattttggcaccctcctcttgccagcaccacagttctgctttggcaggatgttcccacaccagagaaacatctccactcttttgcgctttctgaatgaatgttcttgtcggttcaacaccatcccgccaaaggtggcagggaaagaccggagcccagactcaactggtcttaaaagcacttatcccgctaggaatagggaagggtggcgggtttggaggctgtgaagaaagcaactgttgtggctttcgcctgtcattataacataaaagaaaaaaaaactgatcaagtcagctctggctttcctgctgttcttattcctgatcgcttagcccttgctaagttcgcgtgctccgccactacaccagcggttagagccgacagggaacgagggcttcgggcaagttcgcgggccacgcccctcaaagccggctgcctcttcttattggcctgagagcctgtcactccaatgtggctcccactccggttaaccattcacgtagtttggttgcgtcttggcgtgtttaatgttgccaataacgagggattttttttttttccagaggagagtacaggtcgtgctgcagttagttcattgaaaactcatttgctcttggagcagtcaggcagtgactgccttcggctttttttctgctgactaagatctcctatagagagctacaacaatgcccaaaagaaaggtaagtgaaatggaaagacagacggggaatgagctgctgagttacctatttcctaataggaagaatttatttgtttgtttggttttttttaaagctttttggcttcttccattttgtgatgtaatgaaacggaaaggggtagaagggcaaagagcagtcggtgtaaggtttaggatggtcttgcatgcaactggtagttcacttttggagtgttctgtttaaggagagaatctcttgaaaggtgtctccatgctgaattacaaacagccatagcgctgggctgtcgcttcctaccccaacccccttcctccgcttaccctattggagaacacttctcccaaccatacttcagtttcctcctctgccaccggcttttctcggggaaccgtcccgtctggggaacgaaagccatggctttctcctgtatttgcctttgttcttcccgttttcttttttcttttttttttttccttccctcctcctccacttcttgtcaggccagatggctatgcaatggtaatcctgtgccattaggcggcgcagacttcaaactgtcctagagaacagagattcaccgctgtaattagaaactttaggggtgagaaagctggacctttccaagctctttagctaaagatgggaagattataaggagacagcgtcggataaacttgctgatgttggggtagcatggatttgttcactttagtagtgcagaattgatctgagcctttcgagctccacaggtcttctgcaaaccctcacttcacaattcctggctcctcgcagacaggaaacaagttcacgctcggcgtttttttcttagtcccctagaagtgaaatcgaacgctgtttcattgcttggtaaaaccgtataacactatgctaagacattatgattgtttttggattattcctataaacaactccgccttccttattcctaaaacataggaataatactgaaattcccccgtgctctgtggctgtctgaatcgtgcaatagcttgataattctcaggctaaagggctgctcagatatggaaaacaactgtttctaatcaccatccccccttcctgagattcccgccactgtgcttttctatacttgtgcagtaggtcttgctgttttccagagctgacagcaaccttaaagcaggtagtggcgggaagttttaaaatcggcggccagtttcttagaataaagcattgactttgtaacaaagaggtctccccaagaaaacactgtgggggctgtaattcttgcatgcaaaacttggagaaaatagtccagaatcagtggagaggataagataggtacaattgcatggcaaacataaggcaagaaagcgaaattgcatgaagctccgccttcatttgacccacccccacatttttggcttttacattatctaaagcaggtggatttcaaaattacaaaggtttgcttttaggagatgcaatttacacaaaaggatgaaattaactatcaattgtgtaaaagtatgtcttgtgcatgcacttgcatcttggtgcacattagtaaaacagcagtatgtagcatggttcctaagaaacaacacgtgtctacttgagcaggaacccaggagaaagtaataagcaattatattgaaatttgtaatccgcaggcagtattttctgatttatgtgtttatatcaatgaccttatttctgtgtggttttctcctctgtgtaggctgcaggtcaaggtgatatgaggcaggaggtgagtttctttagtcttagcatctattaggaaaaaccactcgttttataaacttgacataagcagctaaaaaatagatgctggttggtatatttgtacaatatgagttccaatatggtataccagtgggatctctcaaaaatatatatccgaatttcagaagagaggactttttaaaattgccattcagaataaaagaaaaggctttttcacttttttttatagaaatgatggtacggaaatattcttgacaatagagatgtgctaatattttatttgggtgttttgtgggttagactatgatttggtgtgtgtactttacaggcttacatgttgcttactttagaaagttgaggctctaaatgactgttcacatatgtgaaacatttcttaaagtactatatagtttttgttattgcattaaatatatattgttctaactcctagagtatgccatcttctatatgtcctacaaagcgagaatcattgttgtgcgacaattatattaaagaaacctctcagtttacctttatggccttgttaatctaatattttggtcaatgcatattattaattttaatctaattaatgcacaataaaaatatactgagtgtgaaaaaaatgtatatatagtaagtattaaaaactgcaagcttcttcgaatttaagaccttattgtgcttgttcagatgtggagagaacttcttccttttaagcaaaataattgctttgtcatttggcaagaaaaggctatattttcatttctaaatgtgctccttgttactagctactgtgttaatttagcctagctgcttaagcttaatttgggactttttccttagtatgtaaagtgttcagaggacggaaaaatcaaaacttatatttctcttgtattttctaaccaaattcacaattacttaatgacaatatttatgtattgttacaccaaatattttgacctcaataaaaataattctagctttttgtatccataattctcttaacagatttttgtttttaacttatagccaaagagaagatctgccaggttgtctgctgtaagtaatcttttcaaaaagcagcccatgtattgtgaaacgtcattttaaaatttagggaatcctaaaatattcaatacacgatttatttttgaagttttaagaaaaactttcacaccaaggaaatgtattttttttcctaatactcatttattttaattcagaggttggatttcatttttagcgttctttcttcaaatatgatttttttccttttcttttcttttcccacaacttgaagcagatgcttgtgccagttacaccagaggtgaagcctaaaagaacatcaagttcaagggtaaatattcaacgtagaatattgaaataaatttgctttttttttcaaaaataatttttgaaatggcatacagctgatcattttactttgcttatattttgttcagttagtaatatattatattctatcatatgatacatgtaaaccccttgggtggggattatttgttctgttttgtgattgtccacagtgttttgacattttcactgggtagagacaaaacaatttcagttggataggcccattaaatgtacatgcctttgctatcatatagtgacaatactgtttccctgggaaaacaaaaggtgaaaacagtagtaaccccaaagttgtgctttgtaataaaagtagtaactaacatttgataatattttacagttggcaaagtatataagattatatataattatatatataatatatgtaagatgtatttgcatatgttaattttaaatggacacaattgattttgtatggacttatatactctggtgttatggctaaaggcatgtagaaatagatataatctcaatatttagtttactgctaattgcttaatacataagaatattgattgaattcctgaaatcataaaaggttaaagctatgagaaacattagagagcatctaatcctatcactttgtagttgaagaaagtataaactgtcattatgttcataaatgaaatcctttattaaaaaatattgctaaacttagggaaattgaagttttagtaataattgatatatttaatggtgacaaaagaaaagaaggtttttttttctgcattttacttttcaagtccactattatataaggttaaatattcaacttactagtttttaaaacagtaaatacagcatattttcttttaaaaagaaaagtaaggccagacgtggtggcttacacctgtaatctgagtactctggaaggttgagatgggcagattgcttgaacgtaggagtttgagaccagcctgggcaacatagaaaatcaccatcaccacagaaaatacaaaaattagccgggcatgcctgtagtcccagctgcttgggaggctgttgtgggaggattgcttgagcctgggaggaggaggttgcagtgagcagagattgcctcactccagcctgggcgacagagggagtccctgtctcaaaaaaaaaaaaaaaaacggaaaaaaaagaaaagaaaagaaaaatagggctagactaaaacatatactatataaccatagactttaccctccttggctctgtttctcatgtgttaaaagagtaataacttatatctaaattacaaattacagtttctaaagcatttttttcatgtgttttctcattttctccttgtaacatccccgtgaggtgggtggtattactctctttttatatatgaaaataacagcctcaaagatacttatgcctttgctcaagatcacatcacataagtggcagatctagaattcaaacacaggttttccggcccctcaatccagtggtctttctattacatacacaggtaggcaaaaattttcttggtgaagtcgtcatgaatcagggcattccaaacttgtagatacaaagattgaaacacttacatcaccataaggtcttttaaaaatatatctaaattgttgttctcactaacagcatttctcttaattattaccaatggaggcgtaacgatcaacaaaaccctgttccttattaattagacttgacagaaataaactgaccctctctagacagagggaattaattgatcagtctaacctgatgccagcagtttgtccttggcagcaactagtcagcattctaactggttgcctctcatctatatcactcaacttaaaaggaaatttattttgtttatatcaagggaacattgttcatttttaatcctgctttaggcttacaatgaaatttacaatgaagatattatatgataattttgttgataccagatttatatgtgatactttaaagagtttgcataaattattacaacagctggtaaaataattgtgaccatttaatcaacacagcagttaaattgtatatttactttcattgttttatattgcttggcagaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggtattttctaatgttaacagttttatctatttgaaagtttaacaatgggtacaactgaaagaaatcctatttgccttttagtttataagttggaaaaaaattaagtgagcagtggttctatagtataatggtatctaagaggaaaataaaattaacttaaaatatgagaatttagagggaccagtagtgcgagcagtggcttagcattgctgttactagaacaatgccaatgattatgacttagtactaacataacaaccttcttattaaatacaagccaatctttattccttttatcagcacacaggctatttgtaaatcccttttccagaatttatgattcttttatttcctctgtggatggcaaagcaaatcattatataaatgtttttaatcttattttgcatatttaatgcatacaacatttttaggtattgtaataaaacactgaaaatgggtgtagccaccaaatctataaaccaaacatatgcaaatatggaaaatcttttgtaagttatcttataatatctggtacagtacttttcaagtaatttttacataaaaaatatcattattatagaaacaaaatatgttattttccaaggactatattttgtttacatgcatagtcctcattaagaattgctgatacagaataaatatatgtcatcctttaagtatttactttgtgcttcttcatatttgaaataaaaagtatttataagtgtttctgtatttattgtttcaaatatctatttgtagatatttccgtggacatattttagttaatctcatttcttagaatgttttctcataatgtgatatttagcaggcttctttcacaggaaaattactttctttaaatgaagtattagtctttctgtgaaatagatataatccagtgtaaatatttaggggaaatggttctaaatttacagacagaatcttgtttttcttttcactatacttacaggcaccagcttctgaaaaagaaattgtggaagtaaaaga

SEQ ID NO: 5753 - DNA, 85682 bp, human
gagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagctgtatgttgaaaacccatgttctcaaagccttgcgcattttaagattcctattacgtagtgatttttctgatcttagctcgttgtaggaattaggcactaaagtactgagcaatgctgcagagttttgaaggaaagtttcaggtttccttaagcccagaaatggcaggattggttttctttttgaattttgtgttttgttaaattagggaaccctgcttccgtgggaatttgcaggaggcctgattggcaagtttaagaatgaaggaataaattacaaagaaaagattgaaaatattgtgtaaaaagatggatgatttttgttttgttttgctttttaactgactgaagtaagggatttgggagaacatattgcagatgttgaaatggtgaagagagagatcagatggttatttgtagctctaaggaaatgagcaaacagttaataatgtccagagacagaccatatacttcaaagtgtagttttaggttcccagattatgttaaatgaacagaaaaaaaggaatttgcaagatgaatgagagtggagaggagtcagtcgcttgtcctacttcttttcctttgctgtttttccactgtctccagtctagtggtttactgtctttgcctaggctcagtgcttacaatagctttgttaactgttccctacccacaggttttcccttctccaatctgtcttaaatactaattccaaattaatctctttacatgttgtccttaaaacaacctcaagaggtgggtactattacattaattttacagatgaagaaactgaaactcagaaaaatagttttcctaaaatcatatggttagtacattccagagttaggaactccagaggccaccttcttatttttttttaattatactttaaattctagggtacatgtgcacaacgtgcaggtttgttacataggtatacatgtgccatgttggtttgctgcacccatcaactcgttgtttacattaggtatttcacctaatgctatcactcctccagccccccaccccccgactggccccggggtgtgatgttccctgtcctgtgtccatgtgttctcattgttcaactcccacatatgagtgagaacatgtggtgtttggttttctgtccttgtgatagtttgcttagaatgatggtttccagcttcatccatgtccctgcaaaggacatgaactcatccttttctatggctgcatagtattccatggtgtacatgtgccacattttcttaatccagtctatcactgggacatttgagttggttccaagtctttgctattatgaatagtgctgcaataaacatacatgtgcatgtgtctttattatagaaagatttataatcctttgggtatatgctcagtaatgagattgctgggtcaaatgacatttctagtctagatccttgggggatcgccacactgtcttccacaatggttgaactaatttacactcccaccaacagtataaaagcattcctatttctccaaaccctctccagcatctgttgtatgattgccattctaactagcatgagatggtatttcattgtggttttgatttgcatttctctcatgaccagtgatgatgagcatttttgcatatgtctgttggctgcataaatgtcttcttttgagaaatgtctgttcatatcctttgcccacattttgatggggttgtttttttcttgtaaatttgtttaagttcttcgtagattctggatattagccctttgtcagatgagtagattgcaaaaattttctcccattctgtaggttgcctgttcactctgatgatagtttcttttgctgtgcagaagctctttagtttaactagatcccatttgtctattttggcttttgttgccattgctttcagtgttttagtcatgaatctttgcccatgcctatgtcctgaatggcattgcctaggtcttcttctagggtttttatggtgttaggtcttacatttaaatctttaatccatcttgagtcaatttttgtatacggtgtaaggaaaggatccagtttcagctttctacatatggctagccagttttcccagcaccgtttattaaatagggaatcctttccccattgcttgtttttgtcaggtttgtcaaaggtcagatggttgtgatgtgtggtgttatttctgagacctctgttctgttccattggtctatatatctgttttggtaccactaccatgctgttttggttactgtagccttgtagtatagtttgaagtcaggtagcatgatgcctccagctttgttctttttgcttaggattgtcttggccatgtgggctcttttttggttccatatgaactttaaagtagttttttccaattctgtgaagaaagtcattggtagcttgatggggatagcattgaatctataagttactttggacagtatggccattttcacgatattgattcttcctatccatgagcacggaatgttcttccatttgtttgtgtcctcttttatttcattgagcagtggtttgtagttctccttgaagaggtccttcacatcccttgtaagttggattcctgggtattttattctatttgtagcaattgtgaatgggagttcactcatgatttggctctctgtttgtctgttattggtgtataggaatgcttgtgatctttgcacattgattttgtaccctgagactttgctgaagttgcttatcagcttaaggagattttgggctgaaacaatgggattttctaagtatacaatcatgtcatgtgcaaacagggacaatttgacttcctcttttcctaattgaatacccattctttctttctcttgcctgattgccctagccagaacttccaacactatgttaaataggattggtgagagagggcatccttgtcttgtgccagttttcaaagggaatgcttccagtttttgtccattcagtattatattggctgtgggtttgtcataaatagctctcattattttgagatatgttccatcaatacctagtttattgagagtttttagcatgaagggctgttaaattttttcgaaggccttttctgcatctattgagataatcgtgtggtttttgtcattagttctgtttatgtgatggattacattaattgatttgcatatattgaactagccttgcatcccagggatgaagccaacttgatcgtggtggataagctttttgatgtactgctagattctgtttgccagtattttactgaggattttcacatcgatgttcatcagagatattggcctaaaattctccttttttgttgttgtgtctctgccaggctttggtatcaggatgctgctagcctccagaggccaccttcttaactattactgttaactcactgcctggaagagtgaaagtactaaaaaaaaagttagcaattttttcatcctaaaacaccactttcttatattactgaagacaacgtaggcagaaatacttaaattagctctccattgactatcgaactaaacctaaattatgttgctaaacagttttcaccataatctaggcccacactattcatacaatcttacttagtgctcccccaaactaacttccctatgtacgtaatcattgttgactacctgctgcaatcatcatgcttatgatcactctcatgcctttgctcttcctgtttctttcttcaccttctccccacattctcataaccttttctgccctctccacttatccaactcttgcctttgctagacacaactcaaaatctttatacaaataatcaggcaaaagtaagtcagcatgatctagtcaccctcctcattgccaacatcagggctactgctattgcacttttcggcctatgcaacaggagactctttcttctgttttttttttttcattttgcaaaatgaacataatttgtcttatactaccgtagtatgacatccctttcccttctcaagtggacactgctatgctctcacccctcactcagaactaagagtctccaggtgagttattttcatttgccacaccaaaagtagctgaattttcttgatcagcaaataccccctcagcagaagcactctttatcatcactgagctctttggagttgtaattcaccctcttttctcgccctgataattcctcactttcctcttgaggtctttgatatttttcatgtattataaaataccttccaatattttaaattccctttatcaagagagttccagatcacctatccccaccttttccagaagcagaaattttacctacttttaaacttttgagaaagttaaaatattatttacctacaaaacactacaaaattatggtgtagaaatgtttaatgaactgtctgaaaaacattatcatgtcaacttcattgaatattaagtttactatttgtaaaaatttcatttcatttgaaaacaatttggagtttacatttttatctcacataagcagaattcctgtttctgcagagaaatcactgtcgagcatattttaatgaattgcttgtggctgaaaattttttaaattttaaaacaaagttatacaaattttagaatatgcttaatatttatatttaagtgggattataagtacatttgcatttttatgtttgatacactgtgaagtggtgtgtattagtctgtttcacactgctataaagaaataccaaagactgggtaatttataaaggaaagaggtttaattgactcacagttctgcatagctggggaggcctcaggagacttacaatcatggtggaaggcaaaggggaagcaagcttggaccttctcacatggcagcaggagacagaagagggaggagcaacgggggaagagctccttataaaaccatgagatcagctgggcacagtggctcacgcctgtaatcccagcactttgggaggctgagatgggcagatcatgaggtcaggagattgagaccatcttggccaacaaggtgaaaccccatctctactaaaaatacaaaaattagccaggcgtggtggtggccgcctgtaatcccagctacccaggaggctgaggtgggagaattgcagggagaggttgcagtgagccgagatcacgccactgaactccagcctggcgacagagctaaactcctcaaaaaacaaaacaaaacaaaaacaaaaaacaaacaaacaaaaaaaacccatgagatctcatgagaactcattcactatcactagaccagcatgggggaaaccacccccatgatccagtcacctcccacctggtctctctctagacatgtggggattatgaggattacaattcaagatgaaatttggatggggacacaaagcgtaaccaaatcttcccgtttccaaagtaagaatgtctggagtcttggtggtcttcaaagagccttgatttttagaagaaccaacaacatcactcaatgatgccctagtgcccaccttcctgcctcctctggcagatgggagaccagtaatataaaattttttctctattaacacacaacacattaacacataaatatgtaaatcacatacaaaattaccgcacattggaggatatactgttgttctcttcaagtgccagcagaaggggagtatctgcagaggagatagggtaggttaagtaacagagtgttatgcttaagaattcttatcctgtctcagtcacctgctatgtagtgatgtgcatcagcaggaagcaacattgactccttaccagagggagtcctgaagtattgtgttcagaggtctgatctcatcccagatggtacgttcatgattagagccactagagggcgccactcagctatagaaaaacaatgtggaaggctttgaagcgccggacttaagagatgtaatttttattagctctttacagaattccagcagagggatagaatgtcatttcatgcgttgtccctgagcagtaacagtaaatggtctcaaggaaaaataaggctctactcaggagcatcccctatttccaaaaccttctgatagtttgagtaagggttactgccccactcttccgttgggtatcactgactccagaggaggagcgaataaatttggttatcattggaaagagacaggatagggatagggtggaattttaaaccccttaaaacctcagaagtcactctaaccctctgtgatggttaatactgagtgtcaacttgaatggattgaggatgcaaagtattgttcctgggtgtgtctgtgagggtgttgccaaaggagattaacatatgagtcagtggactgggagatgcttacccaccctcagtctggctgggtaccatctaatcagcttccagcactgctagcataaaagcaggcaaaggaacatggaaggactagactggcttagtctcccagcccacatctttctcccgtactagatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtgtgagtcaatgcttcttaataaattcccctttatatatacacctatcttattagttctgtccctctagaaaaccctgactaatacgctctctatcttccccccacatcctaccagtaataactccatagagtggttgtccagaaattacttatgaacacctccagttacagtgagctgaaaattccagaggcatttccattctgcttttagtcagcttaaaacattagaacattattttctgagattaagctgagaactgtttcctttcatgtttctttgattctaataattacccattataaactcatctttatccttgtaatatgaagccttctcttctccaacttagtatttcctgtttctctagccattcttcataagctgtgatctctagaggtgtcactaaatatgtttcagtttgtcagtttctctcttctacaaaaggtcgtcccagaattgaatgtcataatccaagaatggtatgactagcattgtataaagtagtgtaaggtcctcattctggacactttgtttctcttttagcccttttattttctgaggaatagtatttcacagtggttttaatttacatttcactgattactaagaagttgtgcatcttttcatatatttattgccatttatatattttcttttgtggaatatctgttaagaactttttctatttttctatatttttttgtctctattcctaatagcaacattttgtccctatgtgttgcaagtaacttttatcctgaggctagcctttttttaaacatttttaattagtcatatataaaatatttttctttatggttaatgcttttctgtgaatttttaaagaaatctttccagaccctgagaacgtgaaaatgttatcttacatttatttataaaagctttattgtggtgctttttacatttagatctacattccacctggaattgatttgtgtgtaaggtttgagatatatgtcaagtttaatttttttcaaatagctatccaattattctagcaccaataattgaaactacacccttttcccactattttgcaataccatctttgtcaaaaatcaaatgattatacatgcgtgagtctgtttctggtgtctgtattctgtttcatttgtctatttgtctacccttgtgccattaccacactatattacttattataaatttaaatatcttgaaatgtaatatggcaaattctcctactttggtcttcttcatgaagtgtcctgactattcattgccctttatatttccttttaaaaaggtagaatgtttataaccgcaatatacaaatacaattgattatagtatgttgaccttgtatcaagtaattttctaaactcatatgtgaatattaatagtttatctgtatattcttttacattttctatttacacaataacatcaaccataaaaaatggcagctctattttttcttccaatcttatactttttattcattttcatttccttatttcctttgacacctccagaacactcattcctttcaccattgttgtgtaacaaacaaccctaaagcttagtggcatgaagcaaccattttattatactcacagattctgcaggtcaagaattcagccagggcacagaggtgactacttgtctcttctctactgtaattaggacgtcagctggaaagccttgaaggctgggagtcacttgatggctgcaggctaaaaccatttggaggtttctttatttgtgtttctggtgcctttgttgaaatgattcaaacattaagctcagatgtaaatgttgactagagtgcctgaatatggcttcaccacatgactttctcatggcatggcagcttcagagagttgatcttctcatactgcagcttacagcccaatgaacaaggcagaaactagatcatcttttatgaccttatcttggaagtcacatagcatcatttctccgaacagctataatccagaaacaagaaaaacaacacttgaatggactccaaaggaacctttaaggtgacttggataggctccaaaagcaaaagttatatgtctttgaaaaaagatagcatcatctggagcctcattgttagtaccacattttcatctcaaagtctagcactcgattgaaaataatcttacctaaaaaaatagatgtgactgaaaactaaagactagaaaagcacacaaaaattaaaaagaggtattaccatcaaaggagtagcaaaaaaaaaaattattgctgactgtacatcagaacaaatgagaggcagaagacaatgaaaacatggcttcaatgttctaaaagaatataactgtcagcatagaatataactgtgctaaaataataactgtcagcatagaaatctaaagccaacaaaaatatcccttacaaactaatgtgaaataaagacactttcatataaacaaaagagaattattcaccaaagttttacactaattgaaatactaaagaatgtatttcgggtaaaataaaaaagattatagctaagagatgcagcaagaagtgaagaacaacagaaatggcaaatatctgagtaaatctgaatgagcaatgtgtaaaacaataataacaaatgtcttgtgagtttaaaatatgtacagaactaaaagacataagaaaaatttaaaattgtatatataaataaaaaccttcccacaaagtaaactataggcccaggttgtttcattggcaaaatttaccaaacatttaaagaataaataatgccaattttacccatattcttcaatataatagaagaaaaaggatatttctcaatcatttcaagggcagcttagtgttcattccaaagcttgatgagtacatttcaagaaaagaaatacacaggccaatctcatctcttgaaaaatagaagcaaagttactaaactaagtagtatcaaaccaaatccagtagtatataaaaaggatagtactttatgaccaagttgggttattctaattgttaagcagaacactgggcatcacttgctaatcccaggaattgactctaatcacatatgcccattgcatcgctttatcagagtcatgaaggagaacataatgcagtcaagccctggatgaaacaacactttacttatatagaaaaaaaacagagcacaatcagcttcaatagtgtgtgttggtaccctccatggctagacggtaccccctagcaacaaacacagagcaactggataagcacacccttcttgtgccttagaaaaaggacccttatccacacccacaccaacccagtctgaaagacagaaagctaggacatgtctgagagccatggatgcatacacttagtaaaacaaaagaacacttagtaagtctgaaacagaaaaatatttctagcctggaacagggtgtgtaggctgcttatctcttgctaaggaaatattttagtcccaatgcctattttaaatggccatgtgggggtcaaaagactgcatacacaagattgcctttcccaacactaagaattcagggttggttcaacacttgaaaagcaatcaatgtaatgtgcctcattaacttaagaaagaagaaaaatcacatgatcatctcaatagatgaagaaaagtaatgtgataaattcagcttcccttcatgattgaaaattagcaaactagaaataaaaagagcctctttaatctgataaaagatgtatataaaaagctaaagcaaacagtatacttagtggtgaaatattaaacttcttcctgtgacaatgggaatgaaacatgaatacctgctattacctcttctactcaacatagtgctagatattctaggcaatataaaagaagaaaaataaaataaagttataatttttggaagggaataaatttaaatgtaaccaattgtaaataatacacatgtatgtagaaaatacaaaagaaaatctaataaactattttaaataataaattgtttgagcaagataactgcctgcaagatcaatatgtaaatagaatggtatttgaacatattagtaacagacatgggaaataaaaatgtttaaacataccatttaagataaataaaacaatattgaaggaaaagaacagagttggaggactgacactacccaatttcaaggcatactataaagctacagaaatcaagacagtgtggtattggtgaaagaacaaatagatcaagggaatagactagagagcctagaaatagacctacattaatacagtcaactgacctttaataatgaaggcaattgagctaataaggtagttcttttaacaaatggtgctggaataactggatacctgcatgtaaaaaaaaatgagtctagacatgagattttacacccgttacaataattaactcaaaatggatcactgacctaaatttaaaatgcaaaactataaaactcctagaagataccataggagaaaatctaggtgactcagagtttaacaatgacattttagataaaacaccaaaaccacagtccataaaagaaataatccgtaaccttaacatcattaaaattaacaaatttcttacagagaatatgaaaatttatttagatagagagtagattggtagttgctagaggctggtggtgagggtttgggaagaatagaggggttgggaggtgagaactaaagggtatggggtttatttatggggtcgtgagaatgtcctaaaattggttgtggtgatgattacataactgaatatagtgcagataaaaactattagattgtaccctttaaaggaataaattgtataatatatgaattatactttaataaatctgttaccaaataaaatttaaaagttcagctctgcagaagacactgtcaagagaataaaaagagaagccagagactgggagaaaatgtttacaaaagacatatccgataagggacagttttacaaaatatacaaataacaaaatatacaaaatatacgaatacttaaaactcaacaataagaaaatatacaaatacttaaaactcaacaataagaaaacaaacaaccaaataaaaatgggccaaagatcttaagcaacacctacctcattaaagaagttatacagctggcaaatatacatttgaaaagatgctcagcttcgtatgtcatgatggaaatgtaaatgaaaacaacaatgagataccactacacaactattagaataaccaaaatccagaacactgacaacagcaaatgctggtgagaatgtatagcaacaggaacatcattcattgctggtggaaatgcaaaatggcccagccactttggaagtcagtttggtggtttcttacaaaatgaagcatactcataccatattacccagcaatcatgctgcttggtgtttctccaaaggagttaaaaacttatgtctacagaaacaagcacatggatgtttatagcagctttattcacaattgcctacacttggaagcaaataagatgtccttcagtacatgaatgaatagattaactgtggtacatccaaaaatgaaatattattagatactgaaaagaagtgagctattaagccatgaaaatacatagaggaaacttaaatccttactattaagtgaaataagctagtctgaaaaggctacataccgtatgattccaactatgggacattatggaaaaggcaaaactatggatacagtaaaaacatcagtggcttccaggggctgggggtaggtagagacaaataggtagagctatttgaaaatattctatttgaaaacacacagccagaggagacaaaataaaaaacaataaaaaacaagtacacctacaggatctagaaaatagcatcaaaggggaaaatcttaacacagttattggctttcaagaataggtagagaaagagagactctcgggcagcagactttttggtggaaaccttacagtccagcagtgctggaagaagaaaacttttactctagaatagtatattcagcaaaaatatccttgaaacataaaagagaaataaagactttcccagacaaacaaaagctgagagatttcattaacaccagacctgtcccacaagaaatgctaaaaggaggacttcagtcagaaataaaagaacattaataagccatgagaaatcatctgaaatacaaagtaaactggtaataatgagtacacaggaaaaaaaattgtagcactgtgactgtggtgtgtaaactactcttaccttaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcagggacaaaaaaccaaacaccgcatattctcactcataggcgggaattgaacaatgagaacacttggacacaggaaggggaacatcacacatcagggcctgtcgtggggtggggagaggggggagggatagcgttaggagatataactaatgtaaatgacgagttaatgggagcagcaaacgaacatggcacatgtatacgtatgtaacaaacctgcacgttgtgcacgtgtaccctaaaacttaaagtatatatatataaaaaaagtagaaagactaaatgatgaaccagtcaaaaacaataattacaacatttggctgggcacaatggctcacgcttgtaatcccagcaatttgggaggccaaggctggtggatcttttgagcttaggagttcgagaccagcctgggcagtgtagcaaaaccccatcagtacaataacaataataataataataataataataataataataataatattctgtgcacagtggcacatgcctgtagtcccagctactcaggaggctgaggtgggaggattgcttgagcccaggaggcagagattgcagtgagccatgattttgccactgcactccagcctgggtgacagagtgagactctgtctcaaaaaaggaaaaataaacaataattacaacttttcaagacatagacagtacaataagatataagtagaaacaacaaaaagttaaaaaaaaggaatgaagttaatatgtatggtttttaataattttctttttgcttgcttgttaggttttttattcaaacagtgtaaagtttctaactaaaaataatgggttataagatagtaacctcttgtaaggttgtaagcctcatggtaacctcaaatcaaaaagcatacaatagatacacaaaaaagcaagaaattaaatcatacaatcaaagaaaatcacctttaataaaagaaagacaggaaggaaggaaagaagaaagaggaaacacaaatcagccagaaaacaaataataaaatggcaggagtaaatctttacaatcaacaataacactgaccagaaatgaactaaatgctcaagtgaaaacacatagactggctgaatggatttaaaaaatacccaattatctgttgcctgcaagaaacacacttcccctacaaaggtgcacatggatcgaaaacaaaaagatataaaaatatattccataccaatggaaacaaaaaaagaggaagagtagctacactaatatcagacaaaataaatttcaagaaaaaaattctataagaaggaacaaagaaagacactctataatgatgaaagtgtcaatacagtcagaaaatatgacaatttttaatgtaaatgcacccaacactggaatacccagatatataaaacaaatattattagagctaaagagagacagatgccccaatacaataatagctggagacatcaaacacccgactttcagcattggacagctcttccagaaagaaaatcaacaaagcaacattagaaataatctccactatagaccaaagtgaactaacagaaatttacagaacatttcatccagtggctgcagaatacacattcttctcagcacatggatcattctcaaggatagaccatatgtacagtcacaaaacaagtctttaaaaatttttaaaaatattgaaataatatcaagcatcttctctaaccacatggaataaaactataaatcaatgacaagagaaatttaggaaattataaaaacacatggaaattaaacaatatgctcctgaatgaccggtggatcagtaaagaaattaggaagggaatataaaaattggttgaaacaaacgataatgtaaacacaacataccgaaatctatgagatacggcaaaagcactactaagatggaagtgtatagctgtaagtgctacataaaaaaatacttcaaataagcaacctaataatttattgtaaagatgtgcttattttacattgcatgcctatatcaaaacatctcatgtaccccataaatatatacacctactatgtacccaaaaaattaaaaattaaaaaattaaaattaaagtcaaagaactagaaaagcaagagcaaacaaaacacaaaattattcaaagaaatgatatcagagctgaaattaataaatatgaaatgaacaaaataatacaaaagatcaatgaaacagaaagttggtgttctgaaaagataaattaacaaacctttagtcaaactaattctgaaaaagagagaagacccaaataaaatcaatgttgaaatatgtgacatttcaattgatactgaagaatttcaaaggatcattagtggctactgtaagcaaccatatgccaattggaaaatctagaagaaatggatgaattcctacacaaatacaagttaccaaggttgaaccatggataaatccaaaacctggacagatcagtaacaactaatgagattgaagccgtaatagaaagatttttagtaaagaaaagcctggcacccaatggtttcactgctgaattccaccaaacatataaagaagaattaataccaacctactcacactattgtgaaacatagaagaagaggggacacttttaaattcattctatgaggccagtattgctctgatacaaaaaaacaaagacacatcaaaaaaggagaactataggtgaatatctttgttgaatattgacacaaaaatactcaacaaaatacttccaaactgaattcaatcacacattaaaaatatcattcatgatcaccaagtaggatttatcccattaattgaaggatagttcaagatatgcaaatcaattattgttatacatcatataaagagaatgaaagactaaaatcatatgattatttcaattgatgctaaaaaagcatttgaaaaaaatccaacatcccttcatgataaaaaccctaaaaaaactgggaatagaagcaacatacctttacatagtaaaagccatgtatgacagacccatagttagtatcatacttaatgaggaaaaactgaaagtcatttctctaagatcaagagcatgacaagggtgccaacttttgccattgatattcagcatagtactggaagtcctagttagagtaatcagaaaagaggaacaaataaagggtacccaaattggaaaagaaaaataaaattatccttgtttgcagatgatgtaatcttatatttgataaaacctaaaatctcctccaaagagctattagaactaatatacaaattcagtaaagttgcaggatacaaaatcaacatataataactgctagcatttccatatggcaacagaaaacaatctgaaaaataagtcaagaaagtaaccccatttgcagtagctacaaataaaataaaataactgggaattaacttaatcaaagaagtgaatgatctctacaataaaaactataaaacattgatgtaagaaattgaagaaaagaaaaaattggaaaggtattccacaatcatgaatgggaagaattaatattgttaaaatattcatagcacccaagcaatctacaaattcaatgtaatatctgtcaatgtaacaatgacattcttaacagaacaaaaatctaaaaatttgtatggaaccacagtaaacccagaatagccaaagctattctaagaaaaagaacagaactggaggaatcacatacctgacttcaaattatattacggagctatagtaactaaaacagcatggtaacaccataaaaacagacacacagaccaatggagcagaatagagaaaccagaaacaaattcacacacctaaagtgaactcattttcagcaaaggtgccaaaaacatacactggggaaaagaaagtcactttaataaatggtgttgagaaaactggatactcattctcaaaagaatggaactaggtcccgctctcttgccacatagaaaaatcaattcaaaatggattaaagacttcacctaaggtataaaactaagaaactactgaaagaaaacattggggaaactctccaggacattggactaggcaaagatctctttgagtaataacccacaagcataggaaaccatagcaaaagttgacagatgatatcaaatcaagttaaaaagcttctgcacagcaaaaaacaaaaacaaagacaaaacaaagcaaaacaaaaaaaaaaaatcaataaaatgaagagacaacccacccagtgggagaaaatatttgtaaactacccacctgcattactcagttctaacactgctataaagaaatatgtgagacggggtaatttgttttaaaagaggtttaattggctcacagttctgaaggccatacaggaagcatgattctggcatctgctcagtttctgggaaggtctcaggaaactttcaattattgagaaaggcaaaagggaagcaagcatgtcttacttggccagagcaggagcaagggggcagaaggtactatacacttttaaacaaccagttctcacaataattactattgtgatgacagctccaggagggatggtattaaaccatgagaaactgcccccataatccagtcatctcccatcaggccccttctccaacattggctattacaattgaatatgaaacttgggtgaagacaaagatccaaaccatatcattccaccccggcccctcccaaaactcatttctttctcaaactgcaaaatacaatcaggccttcccaacaggccctcacagtcttaactcattccagcattaactcaaaagtccaaatttcaaagtctcatttgagacaaggcaagtcctttccacctaagagcctgtaaaataaaaaacaagttagttacttccaagatacaacagcaatataggcatttaataagcactcctgtttcaaaagggagaaatcatccaaaataagggactacaggccccacacaagtctgaaacccagaaagaaatttattacatcttaaatctccaaaataatctttgacaccaatgtctcacatccagggcacactggtgcaacactgctccaacccctcatttcccctccatgctgccctagcagaggttctccatgagggctccacccctgcagcagcttctgcctgggcatccaagcttttccatacatcttctggaatccagatgtaggctcccaagcctcaactgttgtactctgcacacccacaggcttaatacaacatggaagccaccatggcttatggctttcaccctctgaggcagtgacccaagctgcatctgggccccttttaagccatagctgggattggagcagctgggatacagaaagcagtctcctgaggctgcacagggcagcggggccctgggtctggctcaggaaatgattcttccctcctaggcctccaggcctgtgatggaaggagctgccaagcaagtctctgaaatgctttcaaggcattttttttttcattgtcttggctatcagcacttgcttttctcttagttatgcaaatttatgcagccagcttgaattcctcctctgaaaatggccttttcttttttaccacatgaccaggctgcaaattttccaaacttttatgctttgcttcccttttaaatataagttccagtttcagttcatttctttgctgcttagaaatttcttccatcagataccctaaatcatctcataacagaagtgaccaatacgtttcttatcttcatctgagacctcctgagactggccttcactgtccatatcactatcagcattttggtcataaccattcaaccagtctctaggaagttacatactttccctcatcttcctgtcttcttctgagccttccacactcttccaacctctgcccattacccagttcccattacccagttccacttctacaatttcaggtatctttatagcaatgccacactccttgataccaatttgtcatattagccaattcacacactgctataaagaatacctgagactggataatttataaagcaatgaggtttaattggcttattaatggataaagaaattgtggtacatatacacaggcaggcatacaggaagcatagcagcatctacttctgggaaggcctcagggagcttttactcatggcagaaggcaaatcagaaacaggtgtcttacatggcaggagcaagaccaaggaagcttggggtggggggtgccacacacttttaaacaaccagatatcacaagaattcattatcacaacaacagctccaatggggacggagttaaaccatgagaaatcaccccatgaccaattcacctgccaccaggccccacttccaacattgggaattacaattgaacatgagatttgggtggggacacagaaccaaaccatgtcaccatctgacaaggaatttataaccagaatatataaggagctcaaacagttctgtaggaaaatgcctaataatccaattcaaaaatagacaaaagatttgaatagagatttctcaaatgaagacataaaaatgataaacagatatatgaaaagacactcaacatcattgctcatcagagaaatgcgtatcaaaaccgcaatgatatatcatctcaccccagttaaaatggcttttatccaaagaccggcaataacagatgctggcaaggatgtggagaaacgggaacccacatacactgttggtagtaatgtaagtgagtacaaccactataaagaacagtttggaagttcctcaaaaaactaaaaatagagctaccatatgatccagcaatcccactcctaggtatatagccaaaaagaaaggaaatcagtatatcgaagagatatctgtactctcatgtttattacagccctattcccaatagccaagatttggaagcaacctaagggtctgtcaacaaatgaatgaagatattgtagtacatatacacaactgactactattcagtcataaaaaagaatgagatcctttcctttgcaacaacatagatggcactgtaggtcattatattaaataaaataagccaggcacagaaagacaaacatcacacattctcacttatttgtgggtgttaaaaattaaaacaattgaactcatgaagataaaaactagaatgatggttaccagatgctgggaagggtagtggctagacagagagaagttgggatggttaatgggttcaaaaaacagaaagaatgaataagacctagtatttgctagcacaacagtgtgactatggtaaaaaataattatacctttttcaaaaactgaaagagtataattggatagcttgtaaccaaaggataaatacttgaggtgatggataccccatttacaccaatatgattattatgcattgcatgtctgtatcaaaatatatcacgtaaccgataaatatatgcacatactatgtacccacacaaataaaaaataaataaaaaaccaaaaaatttaaaaataatttaaattttaattaataatgaataaggtttggtgttaaagatgtgtgaagggatatataaattgtctctttttaatgtttttttattatactgtaacttctagggtacatgtgcacaatgtgcaggtttgatacataggtatacatgtgccatgttggtttgctgcacccatcaactcgttgtttacattagatatatctcctaatgctatccctcccccaggccccacccctgacaggcccctgtgtgtgatgttccccgccctgtgtccaactgatcacagtggtcaattcccacctacgactgagaatatacagtgtttggttttctgtccttgtgatagtttgctgagaatgatggtctccagcttcatccatgtccctacaaaggacatgaactcatcctttttatggctgcatagtattccatggtgtacatgtgccacattttcttaatccagtctatcattgatggacattagggttagttccaagtctttactattgtgaatagtgctgcaataaacatacgtgtgcatgtgtctttatagtagcatagtttgtgatcctttgggtatatatccagtaataggattgctgggtcaaatgatatttctagttctagatccttgagggatcaccacactgtcttccacaatggttgaactaatttacactcccaacaacagtgtaaaagtgttcctatttctccatatcctctccagcatccgttgtttcctgactttttaatgattgtcattctaactggcacaagatggtatctcactgtggttttgatttgcatttctctgacggccagtgatgatgagcattttttctggtgtctgttgactgcataaatgtcttcttttgagaagtgcctgttcatatcctttgcccactttttgatggagttgtttttttcttgtaaatttgtttgagttctttgtagattctggatattaggccttcatcagatgggtagattgcaaaaattttctcccattctgtaggttgcctgttcactctgatggtagtttcttttgctgtgcaaaagctctttagtttaattagatcccgtttgtcaattttggcttttgttgccattgcttttggtgttttagacatgaagcccttgcccatgcctgtgtcctgaatggtaatgcctaggttttcttctagggtttttatggttttaggtctaacatttaagtctttaatccatcttgaattaatttttgtataaggtgtaaggaagagatccagtttcagctttctacatatggctagccagttttcccagcaccatttattaaatagggaatcctttccccatttcttgtttttgtcaggtttgtcaaagatcagatggttgtagatgtgtggtgctatttctgaggcctctattctgtttcattggtgtatatatctgctttggtgccagtactatgctgttttggttactgtagccttgtagtatagtttgaagtcaggtagcatgatgcctccagcttttttctttttgcttaggattgtctgggcaatgcgtgctcttttttggttccacatgaactttaaagtagttttttccaattctgtgaagaaagtcattggtatcttgatggggatggcattgaatctataaattatcttgggcagtatggccactttcacgatattaattcctcctatccatgagcatggaatgtttttccatttgtttgtgtcctcttttatttcattgagcagtggtttgtagttctccttgaagaggtccttcacatcccttgtaagttggattcctaggtattttattctctttttagcaattgtgaatgggagttcactcatgatttggctctctgtttgtctgttattggtgtataagaatgcttgtgatttttgcactttgattttgtatcctgagactttgctgaagttgcttatcagcttaaggagatttggggctgaaacgatggggttttccaaatatacaatcatgtcatgtgcaaacagggacaatttgacttcctcttttcctaatcgaatacactttatttctttctcttgcctgattgccctgtccagaacttccaacactatgttgaataggagtggtgagagagggcatccttgtcttgtgccggttttcaaagggaatgtttccagtttttgtccattcagtattatattggctgtgggtttgtcataaatagctcttattattttgagatacgtcccatcaataccctgtttattgagagtttttagcatgaagagctgttgaattttgtcgaaggccttttctgcatctattgaaataaccatgtggtttttgtcattggttctgtttatgtgattgattatgcttattgatttgtgtattttgaaccagccttgcatcccagggatgaagcagtcctgattgtggtggataagctttttgatgtgctactggattcagtttgccagtattttcttgaggattttctcatctatattcattagggatgttggtctaaaattccctttttttgttgtgtctttaccaggctttggtatcaagatgatgttggcctcacaaaatgagttagcaaggattccctctttttctattgattggaatagtttcagaaggaatggtaccagctcctctttgtacctctggtagaattcggctgtgaatccatctgttcctggactttttatggttgtaattattgcctcaatttcagagcctgtttttggtctattcagagattcaaattcttcctggtttagtcttggaagggtgtatgtgtccaggaacttatccatttgttgtagattttctagtttatttgcgtagagatgtctatagtattctctgagggtaatttgtatttctgtgggatcggtggtgatatcccctttatccttttttattgcatctatttgattcttctctcttttcttctttattagtcttgctaactatcaattttgttgatcttttcaaaaaaccagctcatggattcattgattttttaagggttttttgtgtctctatctctttccattctgctctgatcttagttatttcttgccttctgctagcttttgaatgtgtttgctcttgtttctctagttctttcagttgtgatgttagggtgtcgatttgagatctttcctgctttctcttatgggcatttagtgctataaattttcctctacacactgctttaaaagtgtcccagagattctggtatgttgtgtgtttgttctcattggtttcaaagaacatctttatttctgccttcatttcattacatacccagtagtcactcaggagcaagttgttcggtttccatgaagctgtgcagttttcagtgagtttcttaatcgtgagttctaatttgcttgcactgtggtctgagagacagtttgttgtgatttctgttcttttacatttgctgaggagtgtttttcttccaattatgtggtcaattttggaataagtgtgatgtggtgctgagaaaaatgtatattatgttgatttggggtggagagttctgtagatgtctattaggtctgcttggtgcagagctgagttcaagccctggatatccttgttaaccttctttctcattgatctgtctagtactgccactggggtgttaaagtctcccattattattgtgtgtgagtctaagtctctttgtaggtctctaaggacttgctttatgaatctgggtgctcctgtattgggtacatatatatttaggatagttagctcttcttgttgaattaatcccttcaccatcatgtaatggccttctttatctcttttgatctttgttggttcaaaatctgttttaacagagactaggattgcaaccacttctttttttttttttttttttttttttttttttgctttccatttgcttggtagatcttcctccatccctttattttgagcctggtggtgacaaaatctcttggcatttgcttgtctgtaaaggattttatttctccttcacttatgaagcttagtttggctgaatatgaaattctgggttgaaatttttttttaatattttagtacatttattaaattagtaaatgtaatcttagaacatgtattagttctttaagaatgttgaatattggcctccagtctcttctggcttgtagggtttcttctgagagatccgctgttagtctgatgggcttccctttgtgggtaactcgaccttcctccctggctacccttatcattttttcctttatttcagccttggtgaatctgacaattatgtgtcttgctcttactcttctcgaggagtatctttgtggtgttctctgtatttcctgaagttgaatgttggcctgtctttctaggtctttctaggttggggaagttctcctggacaatatcctgcagagtgttttccaacttggtcccattctccctgacactttcaggtacaccaatcaaatgtagatttggtcttttcacatagtcccatatttcttggaggctttgttcgtttgtttttactctttttcctctttgtcttctcattttatctcattaatttcatctttggtcactgatagcctttcttccacttttcaaattggctactgaagcatgtgcatgtgtcacgaagttctcatgccatggtttgcagctccatcaggtcatttaaggtcttctctacactgtttattctagttagccattcgtctaacctttttttcaaggtttttagcttccttgcaatgggttcaaacatgctcctttagttcggagaagtttgttattaccaaccttctgaagcctacttctgtcaactcatcagtcattctccgtccagctttgctccgttgctggtgaggaactgtgatcctttggaggagaggaggtgctcctctgatttttagaattttcaacttttctgctctggtttctccctatctttgtggttttagctacctttggtctttcatgttggtgacctacagatggggttttggtgtagatgtcctttttgttcatgttgatgctattcctttctgtttgttagctttccttctaacagtcaggcccctctgctgcaggtctgttggcgtttgctggaggtccactccagaccctgtttgcctggctatcaccagcggaggttgcagaacagcaaatattgctggctgatccttcctctggaagcttcctcccagaggggcacccacctatatgaggtgtctgtcggcccctactgggaagtgtctcccagttaggctacacaggggtcagggacccacttgaggaggcagtctgtccattctcagagctcaaacaccatgttgggagaaccactgctctcttcagagctcagttggaaatgcagaaatcacccgtgttctgggtcgatcatgctgggatctgccgactggagctgttcctattcggccatagttccatgtagctgggagaggcctcacaattatggcagaaggtgaaggcacttcagtggaaagcaggggctccaacggggtaaaggcatgctccataacagattattggcctacaatagcgggtggagccacagagttgggagcacaggctgcgggagctaaggcgattgactgcttggcatgcggctgaggagcctctgggatatataaattttcaaaatttatttaagggttatggaatcaatatatttaagtgatcctgaagacatgttttcatcttacatttatgaaatttcttcaaactccttataaaaattaaaataaaacatgattgtttattttcctttccacaagtctcgtaactctacaaataaagaaaattaacttaaaactatagttaaccaaaactatatttcataggccgttagtctagaataatgataagtaatacacacatacacacacacacacacacacaaatagaattgttctgtgttcaaatactttgctaaatacctgtttcccatatttatttagccatagaacagattttttaattccagcaccattctattaacatttagtattctgagggacaccagtttgagtaacactggtttcgcataatacattcttagtgaatccacattgacttttagtaacatccatttctttttccaaagtgctttttaatacatttagaatctttcttagacttccactcttatgttcaaataaataaatcatattcttccatcatcagtcttctgaactctcttttattcttcttagtaagattactaatagttgttgatcagtttcatttactaatcttctcactacttattctaagttgttcccccctaccttgtacagcttgagaattatgacaagagtatcatgtgtgaatgcagagtctatttataagtttttggaatggagtcatatactacatatactataaagcagataaatgctactcttaggaaaaaaatacattgcagaaaagaacacttctatttctacactacaagactttaaaatacttattaaattatttattatatggcaagcagtgtgtattttatgtactttcattttttcatttaactcttcatagaaatcctatgaaataggtattattatccttatttgatggaggataaatctaagacataatatttaagcaatttgctcaaggtcatgtaactagtaaagagagaagcaatgtttcagaagtagatgtattttattctatgtttttaactactatgctatactgcctccctgaggacaaactttatatttattccttagtatctcagaatgcctagtatagtagttgctcaaaaaatatttactgaatgaataactatataaacaaatgtatttcagctgggtcaagggactttcatgcattcaaagaatttatgtactctaggaaaatatctctttccatctttaaacgcctatttactagtgttattctacccttatcagtctgtagaagtctgtctaaatactatgagtgtctttcaaaattaattcttgaaattctgtaaattaaataaaaaggaaaaggagattttaaaaacagcttaacagatttctgcataccctttaataaaggactgtatgatgtgtgaggtctctgtggataaacacataagtgtaataaacatttttttaagatttatttcttattttcctataatgagactattattttactagagagtgatcatcttacatatgataatattaatatcttttgttaacttaggagaaattacagaaaaaaatttctaactttatggaagtctctcagttcactgtcttaatttaacacatatctccaggagttcacatcataaagacaaacaaatctaagtgagtaattctaacataagataacgataaatgcaataaaatagacacaagtaagatgttatgggaagagattcactaagataaggtggacttgaaaaggttacattcattcaaagacagtttactggataactaccacttgccaggcactgtgctcattatgagagagacagcaatgccttaaaacaagatttctacactttaggagttcatagctttgtaggaattaccaataagaaacaaaaagtatagtactcactgaggagtgttatagaaaatagtatatatataaaacacacaaaatagcgtggaagcacaagaaaaagaaatattaaatcttcttgagagaaatggaaaagatttgctgaggagctaattttcctattttaaactgtttttatttatcttgttttcaatgtgtaatatagtcacatgtctcaaaataaagcaacataacaaggtttctattcagaagtcccatttctatcctttctcaatctacatggctcctcctacccctccattaactgcttttattcaatattgtggctacttcgagtgtttctttatgtaaaagcaagaaaattatgacatacttcattttcatttccaacctttatttattacaaaggtagtatactatagatactctacctttccttgctttttttcactgaactctgtatcctgaaaccttctcatatcagtataaataaagagcgggtcttcattctttgtttttcaaacaggtgagtagtactccattgtatgaatgtaccataacttatttaaccagttctctgtgatgtacatttgagttatttctaatattttattaatccaaacagtacaccaataaaaagttttgtatatatgcatacacaggtatatctgtagacataaattctagtaggattgttgactcgaacaaattcatttgtattttttataaatattacaaaattaaccttcatagggattgttctaccaaaatatatgagagtgcttacttcctgaagtttattgctgaacattctttttcattgtagtttaatccatatttctcttttatgagtaaggttgagtatttttcatatatgtcttatcagtttctaaaagtaggaggattaggtcttatctgtgatatcagttgcaaatattttttccagtttttcatttgtcatttaaaatttttttatcatgttatgttttatgatcatgtaaattttttgtttatttgcttttaaagtagttgatattatcagtctttgtttctttggcctggactttttaccaaagtttaaaaggtctttcctgtcactcaattatacaaaaattcactgtttccttcttgttcttttatagttttttttttttacattgggtgtttttttctgggtattcagtgtacataacaacaatctctttacatgtattctttcctttgcttttttctggaatactttaaagcaaatttcagacattatgttagttcactccttaatatttcagagtacatatcaaactaataggacttatttttccacataaccacccagttattaccatacctaccaaaattaacaataatgttttaataacatctaatacccagcttaggttaaaattttcctaattatctcaaagatatcttcttccaacttttttctcatcagcatgcaaacaatgtccacacatttggtttttatgtttcttatgtttattctacagtcccctgtttttctctctattgtgtacataaatttaaagagcagagggaaaaaccaaaagagtgaagtgttgctctttgaaaatggatttacagcctcctcaatttttttttttagggaaagaaagatgatttaaacaagcaaataatatttacctttgttcaagcacatttaattttatcaagacacgattcataagaagtaatttgtttttaatagagctacactttatggaattaatctaggattctttaatttgtttcttgtgaacattcttatcggttttcattttacatacttatcacttatttcaaatattttcttataggaggacaaaataatttcagtaatgtatcataatttgggtacaatatgtacaatgaccctgaaccagtgtgattggaatgtagtgatcaagggttggagtgacttgagatgaagtacaaaaagagaaacagatgctaaaccatgcagcactttctagggccattaaggattttagtttttatcctgagaacaatggtgagttatcaaaaagttttaattttccagttgtatacctttaactcaggaaaaccacggatatttctatgtgtgattaactatctcacataaaaatatacaaggaaatgtaatctttttggctcttattcataaacatgtgattcaaaacaatgaattgttaaataactgagtaaattatgttgtcaagtctggaaacatggcatcacatttctgtacacatttccactgacttccaaagtttatgtagaactagaattgacctgctacctgacacattcagagttcaaaagtttctatttgaaagaaagttatatttataaaaatcaaaagtttatatagtcatattttcaggtgttaacttcagtcctattcatttttcttcttacttacctaaaattcatgtttttctgtgataaaagctgaaatcttatcatctttggttggtccatttataaaatcccaagctctcatatgcagatctccaaagtgttttttgtcactgaatattcaccaaatgagatttaaggaactaacagtacacaaataagatgttagaataaaaacacattctcctgagtctcaatagcgatgtgttattcttgtgacagctgtatacatttttccacactcatttcagtctctcaaaatcaacctccctggaaggcagcatattataatagagagaacatcaggattgaagtcagtttgaacaggatggcaaatacaattctatcacataattgctgtataactcagagagtcacaatctctctgagcctcagttttaacatctacaaaatggcaataatagtacctaatgtgcagggttgctggaaggattgagtgagatagtttaaaggaagcatctggcacatagtagatgctcaacataattatgatgttttcttgtggtatttatcattactaatgataatagagtggggaatttgagatatgttagcgtttcctattatatatattaccagatagctgataatacctcattgataattggtatatttaatcaactatatatcttgttgataatacctcattgacagcatttgaaggatcattgattttactctttatgtcctgggtgcacccacttatagttttataaattaggcaattaacattactagacaaattgattatgcctgattttgattcattttcttaatacagtttacttttatacacttattttcttactagaaaaggaatataaccataattgattttcatttcacaggctacatgataatggatataaaatagagttatgttaacaatcatcaaataatttctctttgactctaacccatttgttttaaaaataggtagtgcttgctctactttgctctattcatggactcagtgcatcacaaatagttttgcaagtacttaagggacatgggtatctctcagatgccgtgagaaccagtcttcttggctactatgtaatgactcttattttcttctccttgctgtagtaatgcctcctatgccaaaagaagctatggaatccattgcctcttaagatatctctcactactgatgactgttgaaggttattgctgctggtggtactcctccatggttttttttttttttttttttgagacggggtctcactctgtctcccaggttggagtgcagtggggcgttgtcagttcagtgcaacctccgcctcctgggttcaagtaatcctcccacctcagcctctcgagtagctaggactacaggagcgcaccaccatgcctcgctaatttttgtattttttgtagagatgaggttttgccatgttgcccagctggtctacagctcctggactcaagcagtcagcccaccttgacctcccaaagtgttgggattactggcatgagccattgtgcccagacaatatttttatactaaggctgctgatgtccactctccttgcctaggagggatatctttgtttttttcttgatatccctctatggctaaaacatgaatctctataaatgagctggatcagtaacaaatctaactgagggatatatgcctattctgtaatttgaatcaccctgtctaatgggactggccaatcatctttgaactcatcttgagttctgtgactttctcttccctaaggacaaattatttaacaaaggttatttggcccgttaggtagctaggatcttggcattgttttttcaagcagttctccaagtatgctcagacatgttaaaagcctaagtggaacagtggttgaggatatgctgatatcccctacaacttttattatactcttccatgtataaaaaaactttatagtacatgttacagtctatatcttcactcatgaattggctcttccaagaatcagataataagcagccctttatctgggcactgtaagcttggttaataggctcagattctcacataccaaatcacatcctcccccaggataaccagagtgatagaacaaaactgggctattatccaggtttcaaattactcctagtgtgaattagcactctttttcaagatgagcattttcccttcagttccttgttctcttaccttagagacacaggcctccaggttttgtttcttctagaaattcctgaggcctctctagaaaagcctatgttcaaagaccactgtccattacaaagtctatgggtatgggtaggcagactcccttacttatgatgacaaccactccaatctcatttctaactctctctctagcttagtgtctctgtttcccatggaaatgagacatagtcaactgtaaacttttcctaggcaaaagacagcctcatccaccagtcttagttcccaagcactgggatcacagacatagaaagtcttctccccaattaatttatagttaataaatcctacttgtagacccgctgtattagatccatcctatttcctgccaactgtttttatacaggctgtggccacaaactttagccccactatataggatgtaagtgtacccctgacattcatttcatactgaaaggggagacgcaaagtctacaatagtactcatcacccatcttgaagttactggtaccaaacttgagcactgacagtactgttgtgactcacagcggtatttcatctgggaatttccaggtgtagtttctcacttcacttacccacatgctagatcaagcttattgaatctccattctcaatagccaatccaaattaggggtctgtggacagtcagccccccaccaaataccccaaagtaaaaggtaaacaaagtgggcattttttagaaccttcatagccacatgataagaatgttatgtgctggttccattaacccttttctctgcccccactgcctgcttcctagtatgtacagcaaagtccaatgaaatattttaagttgtgaatcataaagaggatgttctggatttttgtgtatccactacctctagagtactttgcataatagtccatatatagaggtcacctggaatacttcgcataatagcctatagagagagaagcatttcttccataaaatctaggcaactgtgattagagccctttaatttggggcatgatgggtaaaagaattggtttccaagagtctgctcccacaagttctgctatctggttttaaaaacaagaagtctttgttcattaactctatgagcttgccattaaggattgtttccagataggctgccaaatttggaggtcttttgcagtatgcagaagtttcacagtgtatttaatgtcttcattcacccctggcaaacaaaacaaaaaaaaaatccaggtctaaattagttctagggtcttttcttttttaatagtcacagccattgcttaatgctctcacaagtacctgctcatatcctctgagaaaaataagatgcataaaaaaatcaaatgtttctacttcccttacatagaccaatgcaaaatataacttaattcctggcttactatttttaacttttgtcattcttaaagtaaaatcttagtcacactagaagaatatttttcaaagtgcagatcttaatccactaagctattaaatcagttcagttggtcaaaaacagtatttttataaaaggaagtataagatagaaaaataaatataagaatatgtggcatttagaaaagtaattattttgtgaaacttttgcttcagttatatgtttgtgtgtgtgtgtgtgtgtgtgtgtgtgtgtacacaaatatgtttgctggataaagccataaaatgtatttcatttgtggatagtagtcaaaataattgaagatttaaaatccactgtcatggaagagtcaccaatccccaaggtgtagaaggcctttttctcttagctcatcatgctgtcctctaccccatatgttgaggcaccaagagtttatgcaaggcaacatagctgatagctactacagatactgtctgtaggttgtcctaagttttcaaacaggcttgccttcccagagtgccatgtactctgggaattccaaataaacctaattccctccaaggggatagtttctatttcccgtaagtggaacacttgagatgacatatgcacacctttcttgctaatcttggccctataacatagattgaagccttaaaatgatactcagagaacatcaccacccacttatgcctagtgatatctattctgaaagtggtattcagtcccctctccaagacgagcaagttgtcggagacaataaagaccaaggtaggatgtggtattctgggagtcagtgccagcaattatactgaaatggctgtttgggaccttgttgttcatgtagctgggctgactgagtccaagaatgtatgagactttgcttgaacctttctaaagttcttctttgcatgagtctctcttgaatagcatcaccatggaactagtgcttttctataggcattttcaaattggctatacccaagtggtttgggaccttaaatagccagcatccatgttcttccagttgcggaaggcattgctgtcattcagtactacctatacctcaaggtagttcatgtaacccactgcatttccattaggtgttgtggagtggcagaaacttttgttttccactgacatatccttttaaactgataaagatcatttttaattcatctttatcaactcttagaatctggtgattcatgttctacaaatgtaatacagcgatttactagctttctgataagccactctgtgtatcttatatcagccatagtaattatgtatgacttactatgcatatgcatacatacacaaatagaaagtatacatatgtagtaactatgataatctgtgcccattgaaaaatttccagtttcttattctctcattaccataatagatgaggtatatatatatatggaaagaagaatttggtaataatcccattagtcaattacctttaaaatgatttctcatatcatcagtctgatatagcaattctcctagatcagtcgctattaactgggggcaattttgtcattcaaaagacatttagcaatgtctggagacattttggcttgtcacaactgaggcagtggtgctactggcatctagtaagtagagggcacggatactgctaaacactatacaatgcacaaggcagtccccatctcccccacacagagagagaattatttggtcctaaatgtcagtggtgctgatgttgaaaactcctgttctgatcctaatatttttgttgttgttgtttttaaggacttttaaccaaaataggtcaccaattaactgcagctgatatctgttattacattagcatttagagcattaacgatataatcatttatcataatacacaaaaaaggtagaacaagaaagaataatgtagcttttgtatccatggctgatcctgacgtttgaccctgacatttacttaagtcattcaaacatagtgggctattccttttttacacacttctattcatagagagactataccatggcaataaccctgatcttccttctcaagctttcattcaacttctcagaacttgaagagaccccagtctcaaaattaagttaacttacgtcttagacttggaattttataggataatgccctggaggaaaatagaaaatgagagctgtttgtttctctttgtctctaacttctggtgagctaatgtgtataagacaagtaaggggagttttgttaaggatctatcatcagtctactgctggaaataatattctgggactcgaaaaggctaaaattagcctcaatcaatgttatatacactacaacaggcttgattcagctcatctcagtggcaaatatgggggaaatataatgagttcaattttaaatatcatgagtttgaggtgcctgtgagtcattcaagcggagatgtcaagtaggtaattgagtatatggaattgcacgtataaacagaaatgtaggcatcatcagcttatagacagtaattgaatccatgggaatggatgagaccaactaaggaaaaaatacagatttagaagagaaggtagcccatactgaattcttaggtactttcaatatttgatgtcagataaaggattattccaaaatcgatgacctttccactatatcatgctgtctcccagatagaaagtgagctgcatttaatcattcaataaaatttcacattaagcacctctcatatgccagacactattgtaggcacttgggatacatcagtttaaaaaaaactgacaaaaatctcagagcttaaaagaggttatagtctagtgagtttctttataatgaaacaggggcacccttccacagctcagctgatagagtggaagactgtgggggttataataaaacaagggttacagaaggctttacttccctgctgtaaagcctctaaacccctgaaactctcaatcccctcaccttcaatattagaaagaaatcttagacagcatcttattcttccctttcccctactccagcttctttgtttggtactgcatgtgactagtttttatacaaatttgccagttgccttgaacaaatagataatagagcaaccaagaaattagagagacattgaccttgggtgaaaggaaaaagaaagaatgtcacataaaaaggaatgagaggcattcataataaaataaataacattataggcccaagttaagataagtggacaaagaaatctcagttcctagattgacaaaatataacaaagttgggaaaacctagcaacaaggtattagagagagtgagggtaaggaggtggtcctggtttgaaaatgctagcatgcattaggaaggaacaattagaggaaaatgtggtaaactcacacagctatctttctgattctgtatctttcttattgttatcttggattcagttttactcccatcaagcaacaaattgatgtgagtcacaccacataataaatacattgaactaaaatttcatgataaaacttttgacattctcagcactttaaaaatagctctgttatttgaggggactgggattcacttagggaaagagcacagtaacacataaagacagcttttctgctgcttcttaaaatagcattgattgtgttgggcatctatctgcttttgcacatctctgacatttctgttccaacccaggggccacttttaaacaaatatgaaactacagagctttatgtggcactccaaggacacttgtaaaataattatttccttagttctttgccatgcccctgactgcctagaattgaaggcctatacaataaataacctgtctcagatctcaggaggatattagtgtacaaatcagtgaatctcaaatggagatcgcataagaatctccaggatttagggactttttaaaagtacacattcccccatcctatcccctgtagattattatgtatacctcttatccttacacataaaagttacttctatagagagacaatattacttatgagaaaaggtttcattccttaggttaggaaggtagaaaggttgaagaatactgacgtgtttgacatttttaaatatattccatagatacatctctctaacaaactcccagttccagcagtagtgagttttctatatcagtactgtttccagactaaaacaaacaaatcatcaaaagtctagagatggaattcctcagccagaactgtccagtagaacattctacctgtctgtctagaacttgatttaagattcaagggtactggctatcaggtattgttccagttactatttctatgtgacaagtcacccaaacttagtggcatacaacaattgattcattaatctcagattctgaatcagggtcagaaatttggaaaggacacagcagggatggattgtttgtgctccacagtgtctagggcctcagctaggaagactcaaaagtctgaaggctaatattgtctaaagcttcactcacttccatgtctggcagttgaggatgctgagtatcagtcatgatctcagctggggctgtcagctgaaacacctatgtgtgacttcttcatgtagctgcttggagttcatcacagtatagcaaatgggttacaagaacaagtttccaaagagtcatggagtaaactagctttggaagtcacaaaacattacttgtaccaagtcacaattacactcagattgaatggaggggaacgcagaccccatttcttgatggaagaaatgtcgaagtcacatgttcaaaagagcatgtgggattggagatatacagtgtagtcatctttggaaactacaatttgctataatctgcccactaggtacaataactaatatcctcccaacattcaaagtattctaattccctcctccaagacctctaagtcgcataatgacagcagctcaactacaaggtctcattttctatattaggtccaggtgcagatgaagatcctaaggtttgattcttttgagtacagttccataagcacctcttgacctgaagacatgcaagctaaagttacaagttacctgctctacacattcaacataaaattatggggccaggcctagaataattgccataggccctctcatggaaatggaagaggggatggaaagactgcagcagtcactagttcataacaattctgaaatatagctaagtacatattgccagttccttgttttgtcctactgcttgagatctactctctattacttctcactctgcctctagtctcttggttccattttctgtgtcatctttccttgtttcataaaaaaagcttatgtttgcagctgagtggtttttttttttttttcagtttgttttctcctgtagtagtctggaagtccaaagcacttcattttgtactatctctatccttttaagtccaacctattgcacaattccttgaaaaattttctgtgtaccaatttataatccactctatcagacaaaagccataataagagatttccattgttttttctaccttgggctccctgtgaggctgctgtggtataacccccttaaacttaaaagctccatcacttagcaaaaagagatctgtatctgtccttaagatccttagaaggcctttgttctgtctgaaaggttctaggaggcactgctttacatatttttgaggctttaacaaagagtcccaacctggtttttatctttagcacagagccttttttgatttgagaatctctgtatggagagactgggaaagtgaaatagtattgtattcaaacttaccaagtactgcattctttataataagagtcaaacctttagctcgtatatttccttttgcgttttatcatatgcagtgaaaagaagccaagtggtattttacacatctctatagctagttcatcaagtttactaggtgtatcctatttttcatgttaccacagaagggtgttgctgactttctgctactaaagaacaaggtctccctttcacagagcttccattttttcttactttcctttaagccctcaccaacagcccctttaaggctctgaaggcttttttctatcactctcttcaagagtctttcgtactcctctgcttcctggtccacacattttcaggttttcttataacagcactctacttacaggtaccaaattatatttcagttagcaataattgagtaacaaagcattctaaacttagaggcacaaaacaacaacaattttattatgcttacagattctttgggcttagaatttggaaagaacataacagaaatgtcttggttttgctccaaaatgtctaaggtctcagctgggaatactcaaagactaggggataggagcatttgaaggcttattcattcatatatctggcagtaaatgctagccattagttgggccagaactcctacctgtggtttttccatatcactgattgaagactttatttatagaaataattttgagggtactcattaacatgtgtccaggggtcagtcgtcacaacttggaacatcagatcagtaaggaagcacagctcatatttcacacaatgggcaatattcttggggcaattcaagttcaaacacgcacatactaggtaaccaaaacttctgggtagatgcattatcatgccatccaggatgacatggggtagcaggagccacttaaccccagaagatcctctactctggaaattttataattgtctatcaacagttggaaataactcatcagatataaacaatcagcagatgattatatatgtccttgcttgaggtcctctgtgaaagacaccaaagttgtagactgaactaggaacacattccacagaatgattggttgaagatgtccactcaaaaagtctgcacacaagcactatttacaataacaaacacatggaaccaacccaaatgcccaacaatgataggctggataaagaaaatgtggtacatatacaccatggaatactatgcagccataaaaaagaatgagatcatgtcctttgcagggatatggatgaagctggaagccatcatcttcagcaaactaacacaggaacagaaaaccaagcaccacatattctcactaacaagtgggagttgaacaatgagaacacatggacacagggaggggaacatcacacaccagggccagttgtgaggtgaggggcaaggggaaggagagcattaggaaaaataggtaatcaatgtggggcttaaaacctagatgacaggttagtaggtgcagctacccatcattgcacatgtatacctatgcaacaaacctacacatcctggaactgaaagtaaaataaaaaataataaataaataaaaagcaagaaaagaaaaagaaaaaagaagtctgcacacaagttatttgcctctggacattaccacagggtcttgttaatacactgatagtaaattttctgggatttctattgatcttatatcaggaatgatgtcttcaatatgccacaaattttcctgaatcaagaaacacccaacaaatcctaaacctgctaagatatctttatcaaggttgatatgggattgagaattgagattatacagtaaatacaattctgaatgggctgtcttcatctacaacaacatcacaagcattttttcatgtaattgcattattttcataactagaaatattaaattcaacagttttcccttaagatttaattgcatacaaatatttgaatgataaaaaactcaagtatgtcaataaattatatctacatttcaaatctcagagatgaatattgtatagggattcattttgaagtaaagaaaaagtactcctttttaaattaatacattaaaagttgtgcttttatcataaatatattttttagtattaaaaaactgactatggctcatgcctgtaatcccaacactttaggaagctgagaggggccatggtttgagcccaggagtttgagaccagactggacaacatagtgagacactgtctctatcaaaaaaaaaaaatagaatttcacaggtaagttaagtattaaccaagagagacaaaattatcctaaaacttttgtttacctccttaactaccatttgaattctccctctggctcaaatggttattgattcatcttatcacccaagatgctttggccctctgggtaggactcttattgaactctccacaacttaaataggacatgatcgtcatattatgaaacccatagttttagaagcactacacgtattgatagagatgagctgacagcatttgtgcagacttttctttttttaaatttttatttttatttgaagttctggggtacatgtgcaggatgtgcaggtttgttacataggtgaaagtgtgccatggtggtttgctgcacctatcaactcatcacccaagcattaagcccagcatgcatcacctatttttcctaatgctctttctccccacactctatcccccaataggccccagtgtgtgttgttcccctccctgtgctcatgtgtttccattgttcagctcacacttacaagtgagaacatgcagtgcttggttttctgttgctgcgttagtttgctgaggataatggcttccagctctatccatgtcccagcaaagaacatggtctcattcctttttatagctgcatagtactccatggtgtatatgtaccacattttctttatccagtctattattgatggacatttgggttgattccatgtctctgctattgtgaatagtgctgcagtgaacatacacgtgcatgtatgtttgtaatagaatgatttatgttcctttggatatatacccagtaatgagatttctggaccaaatgctagctacacattatacaaaaattaactcaagatggattaaagacttaaatgtaaaacccaaaactataaaaaccctagaagaaaatctaggcaataccattcaggacataggcacaggcaaagatttcatgacgaaaactccaaaagcaattacaacaaaagcaaaaattgacaaatgggatcgaattaaactaaagagcttctgcacagcaaaagaaactatcctcagagtgaacaggcaacctacagagtgggagaaaatttttgcagcctatccatctgacaaaggtctaatatccagaatctacaaacaacttaaacaaatttacaataaaagaaaaccattaaaaagtgggcaaaggacatgaacagataattctcacaagaagacattcatgtggccaacaaacatatgaaataaagctcaacatcactgatcatcagagaaatgcaaatcaaaaccacaatgagataccatctcacgccagtcagaatggtgattattagaaagtcaagaaacaacagatgctggcaaggttgcagagaaataggaacacttttacattgttggtgggaatgtgaattagttcaaccattgtggaagaaggtatgcagtcttttcattaggacaacactggaaggtaactaagcaatttttggaagaaagcaattatagaactattggttttaatcaaatgtcttactcatacatctcaggacacaacatttgcacattttttttcaggtatataatgccatttaaaacattttacttggctgggcctggtggctcacacctgtaatcccagcactttgggaggccgaggcaggcagatcacaaggtcaggagatcgagaccatcctggctaacatggtgaagccccgtctctactgaaaatacaaaaaaagtagccgggcatggtggcgggcacctgtagtctcagctacttgggaggctgaggcaggagaatggcgtgaacccaggaggcagagcttgcagtgagccgagattgcgccactgcactccagcctgggtgacagagcaagactccgtctcaaaaaaaaaaatttattttacctgggtcagttgataaaattttttatataactccaggaaactcaggcctcataattctgaggaaggtggaatattttaaatatcctatttgatggaaaatatatagactaggtcattctgtccataggtccctatgccatacctatgttggattagtattagcactctggagggtatgtgagttcttgtttatgaggagacgccaatactttcaaggtaggggacagacattgtttaaaagttccagttttggaaaagatgtgctatggaataatgctgccctaaccatgacattcaaggaaacgctttcgacacttttatgtgaacaactgttatagatctctaaggctggtcacctgggatctgtatatacagctgaaaggctacccggtcaaatgcatccacctcttagacatcctgtttcagtctagcaccagctatgactgagtaaatacactagcagaaaacaccttattgcagaaaattcagccactttatgtaaaagtgtgccaggcccactggcaagaaatgctgcagctactcagtaatgataaaatcagctaagccctcctgctttagctttatctaaattaggggggatcttggctgcccatatacccacacactggcagatttcaaggcaatgggaaacttaataatggtccagcagacccagactcacttcaaacctctgccaggctttgcatacatgtaaaggcaatctgcttccaagagagacccactatctataagaatctactagggtagaaaaattcatggaggttctcatgctcatgttggtacttaaaacttaatagttctaggcccataagtgaactataatcagaagcatcctgaactacgagcttcatcttaaacaactgatagtatcagtgcccacaggttattcaggggtgcctgctttatcaatcacactgacaagcagagtgcaagacaagaaatcaatcttcggagaagccatctctcaacagaagacagaagagttaccccatttattcagttattaaatagataattattgtaaacttactatgagataggcccttgggatacagtggtgagcaaagtagacaaaaatccttgccctatggagcttactttctagagcaggagatagaaaatgaaccaaataaataagtaaattaaattgcttattgaaagtgataagtgctgtggagataaataaagcaaataaagggaatacagagattatttttcaaataagtcatcaggaaaggtctcactgagacactaatatttaaccaacgacttcaagtttgaagttggaagacccataggtgtgtagagctctagacagagggaccaagaattgggaatttcaactctgatttaaactttaggctgaggcctcagtcattttgattaaataaaaagtgaatcagcatgatggtagctgttgctaatatgtgttagcctggcttcacttctgtccataccttggcctaccttgatttagatcacattcacatagtacaatgtctgctcccattactactttggaggcaaacatattgcaggaggataccagccacaccaataactacaatgaccatttgatttttagaaaacaaaatgacattgagtattttggagaacaggttgacaaattctattccataagccaaactcatccatttttttaattgaaatttttgttgagagaactatggattcatatggagttgtaggaaatattagagtgataccatatactttacccagtttcccccagtggtaatgactttcaaaactatatcacaaacaggctatttacaagagacaatcctctgaccttgttcacatttctacatatttttatgcactcatttgtttgtgtgtgtgtgttaagttctaagaaattttatcacaaatataggttcatgtatacactatcacagtctagatacaaaccaactccattatgacaaggatccattatgttgtgtttttctaactactgcccccagctccttcccaattactaccctgttcataatccctggcaatctgttatttatttctaaagttttgttatttaaagaatgttttaaaaaggattcacagaatatgtgatcatttggggttggtttttttcactcgacttaattccctggaaattcattcaagctattggatgtagcaattgttcattcctttacattgctgtgtagtattccatggtatagatgttccatagcttaaccattaacacattgaaggacatttgagtttttactgtttgtggctattatgaataaagctgctacgaacattcctgtacagctttatgtgtgaacataagttttaactctccagggaaaaatgacccagagggcaattgctgagtggctgtgccattttacattctcacctgcaacatatccatgatgcatttctccacattcttgccagaattttctaatatctctaatttatattttataattatattatataattatataaattataatatctataatttatatattatataatcagccactctctaattacatattatataatcagccactctctgattacttctaattttctaatgggttgtaaggagttttttggttaagttttaagagtatatatatatatatatatgtgtatgtgtgtgtgtatatatatatatatatatatatatatactgatatatactgatatcctttcttttaggcatatacccggcagtgggattgctggatcatacttttagtagctctatttttggtagctctatttttagtcatttgaggaacttccaaactgtttcctacagtggttgtactaatttacattcccaccaccagtgtacaagggttccattttctttacatcctcaccagcatttgttatttgctgttgtttttggatataagccattttaactgaggtgaaatgatatctcattgtagttttgatttgaatttctctgataatcaatgatgttgagcaccttttcatatgcctgtttgccatttgtacgtctccttttgagaaatgtctattctaatcttttgctcatttttaattggattattatacttttttttcctatagagttgtctgagctccttatatattctggttatgaatcccttgtcagatgggtagtttgcaaatattttctccaattctgtgggttatctgtttactttgttgattgtttcttttgctgtgcaaaagctttttaacttgatgtgatcccatttgtccacgtttgttttggttgcctgtgcttgtgggagataatgctcaagaaatttttgcctggtctgttgtcgtggggagtttctccagtgtttctttgtattagtttcacagcttgaagggtcagatttaagtctttaatccattttgatttgatttttgtatatggcaagagataggagtcaagtttcattattctgcatgctgatatccagatttcccagcaccatatattgaagagactgtcttttccccagtgtatattcttggcagctaccttaaaaatgagttcactgtatatgtatggattaactctgagttttctattctattcctttggtgtatatgtctgtttttatgccagtaccatgttgttttgattactaaagctctgtagaatttaaagtgaggtaataggattcctccagttttgttctttttgcttaggataatttcggctatcctgggtcttctgtggttccctataaattttagaatttttttctatttctgtgaagaatgccattggtattttgataggggttgcattaagtctgtagattgcttagggtagtgtggacattttaataatattgattctatgaggtatttttccttttttttggtatcctcttcaattgatttcatcttgttttatagttttcattacagagctctttcacttttttggttaagttaattcctaggtatttaattttatgtgtggctattataaatgggattacttttttaaacttcattttcagattgtatgtagattttgtatcctgcaacttttctgaattttttaatcagtctaatagttttattctggagtctttagtttttttcaaatataaacaaggagatacatatatatatatatatatatatatatatatatatatatatatatatatatatatatagagagagagagagagagagagagagagagagaggcagagtttcgctctgtcacccaggctggagtgcagtggcttgatcttggctcactgcaacctttgcctcccaggttcaagcaattcttgtgcctcagcctcctgagtagctgggattacaggcgtgggccacaacacctagctaatttttgtatttttattcgagattagggtttcatcatgttggccaggctggtcttgaacttctggctttaagtgatctacccacctcagccttccaaagtgctgggattacaggtgtgagccaccaagcccagcctgatctttttagtgtattattgaactcagttttgaagtatttcgttgaggatttttgcatcaatattcaagagagatattggcctatagttttctttttttatttttttattttttttaattattattatactttaagttttagggtacatgtgcacaatgtgcaggttagttacgtatgtatacatgtgccatgctggtgtgctgcacccattaactcgtcctttagcattaggtatatctcccaatgctatccctcccccctccccccaccccacaacagtccccagagtgtgatgttacccttcctgtgtccaagtgttctcattgttcaattcccatctaagagtgagaacatgtggtgtttggttttttgtttttgcgatagtttactgagaatgatgatttccaatttcatccatgtccctacaaaggacatgaactcatcattttttatggctgcatagtattccatggtgtatatgtgccacattttcttaacccagtctatcattgttggacatttgggttggttccaagtctttgctattgtgaatagtgccacaataaacatacgtgtgcatgtgtctttaaagcagcatgatttatagtcctttgggcatataccgagtaatgggatggctaggtcaaatggtatttctagttctagatccctgagggatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcctcttttgagaagtgtctgttcatatcctttgccgactttttgatggggttgtttgtttttttcttgtaaatttgtttgagttcattgtagattctgaatattagccctttgtcagatgagtcggttgtgaaaattttctcccattttgtagcttgcctgtccactctgatggtagtttcttttgctgtgcagaagctctttagtttaattagatcccatttgtgaattttggcttttgttgccattgcttttggtgttttagacgtgaagtccttgcccatgcctatgtcctgaatggtaatgcctaggttttcttctagggtttttatgtttttaggtctaacgtttaagtctttaatccatcttgaattgatttttgtataaggtgtaaggaagggatccagtttcagctttctacatattaaaaggtattaaattaggaaaagaggaagtcaaattgtccctgtttgcagacgacatgattgtatatctagaaaaccccattgtctcagcccaaaatctccttaagctgataagcaacttcagcaaagtctcaggatataaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggatctcttcaaggagagctacaaaccactgctcaatgaaataaaacaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctacatcgccaagtcaatcctaagccaaaagaacaaagctggaggcatcatgctacctgacttcaaactatactacaaggctacagtaaccaaaacagcatggtactggtacaaaaacagagatatagatcaatggaacagaacagagccctcagaaataatgtcgcatatctacaactatctgatctttgacaaacctgagaaaaacaagcaatggggaaaggattccctatttaacaaatggtgctgggaaaactggctacttttcttttttttgatgtgactttttctggtttgggaatcagggtaataatagccttgtagaatgaggttggaagtattccttgtgcctcaatttatcagaatagtttgaataggattggtgttagtatttagttaaatttttcatagaattcagcactgaaaccatcagcttttctttactgggatactttttcttacggcttcaattttgttacttgttgttctgttcagggtttggatttcttccttgttcaatttttgtaggttgtatttgtctaggaatttgttcatttcttctagattttccaatttattggcatatagttgctcatagtagctactaatgatccttcgaatttctacagtgtcaattgtaatgcctcctttttcattttccatttaattgaatcttctctctttttttcagttagtctgcccataggttcgtcaatttggtttaacttttcaaaaaagcaactttctgtttcattgatcttttgttttgctttcttcatttcaaaataatttattactgcttttatatttttaattttcattttgttttgtttttgtttttgttattgttttgttttgttttgcaagacagagtttcactctcagtgcccaggctggagtgcaatggcacgatctcagttcactgcaacctccgcctcctgggttcaaagcgattctcctgcctcagcctccctagtggctgagattacaggtgtccgccaccatgcccagctaattttttgtatttttagtagagacggggtttcatcatgttggctaggctggtctcaaactcctgacctcaggtgatccacccgcctcggcctcccaaagtgctggggttacaggtgtgagccaccgcacccagcacatgtgtttttacagttcccaaaattccttatgttatggatttctaattttattccattgtgttcagagaggatgcttgatattatttcaattttagaaaacgttttaaaacttgttttgtgacctaacatatggtctattcttgagaatcatttatgtgctgaggaaaagaatgtgtattctgcagccgatgaatgaagtgttctgtaaatatctgttagaatcatttggtctatatagtgcagattaagtctaatgtttcttttttgattttctgtctggaagatctgtacaatgctgagagtggggtgttgaggtcttcagctatgactgtatggggacctatctgttgctttagccctagtaatatttgctttataaatccaggtgctccaggttgggtgcataaatgtttaacattgttaaagcatcttgctgaattggtgactttatgattatatagtaaccatctttgtctcttgttatagttttgtcttgaaatctattctgtctgatgtaagtatagctactcctgtgctttttcagtttccattggcatggaatatatatttccatccctttatgttcacgctatgtgtgtcttcataggtgaattgtatttctttcaggcaacagatcaatgggtcttgtattttttattattatacttcaagttctggggtatatgtgcaaaacatgtagattagttacataggtatacatgtgccatggtgctttgctgcacccgtcaaaccatcatctacattagatatttctcctaatgctatcccttccctagcgctccccaccccctgacagggcctagtgtgtgatgctcctctccctgtgtccatgtgttcaactccctcttatgagtgagaacatgcagtgtttggttttctgtgcttgtgttagtttgctgagaatgatgttttccagcttcatccatgtccctgcaaaggacatgaactcatccttttttatggctgcatagaattccatggtgtatatgcaccacatttttttaatccactctaccattggtggacatttgggttggttccaagtctttgctattgacaacagtgctacagtaaacatacaagtgcacgtgtctttataatagaatgatttataatcctttgggtatatacctagtaatgagattgctgggtcaaatggtgtttctagttctagatccttgaggaattgccacactggattccacaacggttgaactaatttacactctcaccaacagtgtaaaagtgttcctatttctccacatcctctccagcatctgttgtttcctcactttttaatgatcatcattctaactggcatgaaatggtatctcattgtggttttgatttgcatttctctcatgaccagtgatgataagcatttttgcatgtctgttggctgcataaattttgtcttttgagaagtgtctgttcatatcctttgcccattttttgatgggattgtttttttttcttgtaaatttgtttaagttctttgtagattctagatattagccctttgtcagatgagtagattgcaaaatttttctcccattctgtaggctgcctgttcgctctaatggtagcttcttttgctgtgcagaacctctttattttaattagatcccatttgtcaattttggcttttgttgccattgcttttggtgatttagtcatgaagtctttgcccatgcctatgtcctgaatggtattgcctaggttatcttctagggtttttatggttttaggtcttacatttaagcctttaatccatcttgaattaatttctgtataaggcgtaaggaagggatccagtttcagctttctgcatatggctagccagttctcccaacaccatttattaaataaagaatcctttcccaattgcttgtttttgtcatgtttgtcaaagatcagatggttgtaggtgtgtggtgttatttctgaggactctgttctgttccattggtctatatatctgttttggtaccagtaccatgctgtttttgttactgttgcctagtagtagtttgaagtcaggtaacgtgatgcacacagctttgttctttttgcttaggattgtcttggctatgcaggttcttttttggttccatatgaaagttcaagtaattttttccagttcagtgaagaaagtcaatggtagcttgatggggatagcattgaatctataaattactttgggcagtatggccattttcatgatattgattcttcctatccatgagcatggaatgtttttccatttgtttgtgtcctctcttatttccttgagcagtggtttgtagttctctttgaacaggtccttcacatcccctgtaagttggattcctaggtattttattctctttgtagcaattgtgaatgggagttcactcatgatttggctctgtgtttgtctgttattggtgtataggaatgctagtgatttttgcacatcgattttgtatcctgagactttgctgaagttgcttatcagcttaaggagattttgggctgagacgatggggttttctaaatatacaatcttgtcatctgcaaacagagacaatttgacttccttttttcctaattgaatatcttttatttctttctcttgcctgattgccctagccagaacttccaatactatgtggaataggagtggtgagagagggcatccttgtcttgtgccggttttcaaagggaatgcttctagtttttgcccacttagtatgatattggctgtgggtttgtcataaatagatcttattatttttagaaatgttccatcaatacctagtatattgagcgtttttggcatgaagctaaatatcttttctgtatcaatttaaataatcacgtggtttttgtctttggttctgtttatgtgatggattatgtttattgatttgcttatgttgagccatccttgcctcccagggatgaagccaacttgatcatggtggataagctttttgatatgctgctggatttggtttgccagtattttattgaggatttttgcattgatgttcactaagggtactgtcctataattttctattttgctgtgtctctgcaggttttggtatcaggatgatgctgacctcataagatgagttagggaggattccctttttttctattgtttggaatagtttcagaaggaatggtaccagctcctctttgtacctctagtagaatttggctgtgagtccgtctggtcctggacttcttttggtttgtaggctatgaattgctgccccaatttctgagcttgttattggtctattcagggatttgacttcttcctggtttagtcttgggagggtgtatgtgtcctggaacttatccatttcttctagatttcctagcttattggcgtagaggtgtttatagtattctctgatgttagcttgtatttctgtgggatcggtggtgatatcccctttatcattttttattgtgtctatttgattcttctctcttttcttctttattagtctgactagcagtctatctattttgttgatcttttcaaaaaactagctccttgattcattgattttttgaagggttttttatgtctctatctccatcagttctgctctggtgttagttatttcttgtcttctgctagcttttgaatgtgtttgctcttgtttcttttgttcttttagttgtgatgttagggtgttgattttagatctttctttctttctcttgtgagcatttggagctataaatttccctctacacactgctttaaatgtgtcccagagattctggtacattgtgcctttgttccccttggttttaaagaacatctttatttctgccctcatttcattatttacccagtagtcattcaggagctggttgttccgtttccatgtagttgtgcagttttgagtgagtttctcaatcctgagttataatttgatttcactgtggtctgagagactgttatgattttcattcttttgcctttgctgaggagtgttttacttccaattatgtggtcaattttagaataagtgtgatgtggtgctgagaagaatgtgtattctgttgatttgtggtggagagttctgtagatgtcttttaggtccacttggtccagagctgagttcacatcctggatatccttgttaatttctgtctcattgatctgtctattgttgacagcggggtgttaaagtctctcactactattgtgtgagagtctaagtctctttgtaggtctctgagaacttgctctatcaatctgggtgctcctgttttgggtgcatatatatttaggatagttagctcttcttgttgcatttatccctttaccactatataatgctcctctttgtctgttttgatctttgttgatttaaagtctgttttatcagagactaggattgcaacctctgcttttttttaatttccatttgcttcgtaaatattcctccatccctttattttgagcctatgtttgtctttgcacatgagatgggtctcctgaatacagcacacagatgggtcttgactctttaaccaattcttcagcctgtgtcttttaatttgcccatttagctgatttacatttaaggttaatattgttatgtgtcaatttgatcctgtcattatgatgctagctggttattttgccaattagttgatgcagtttcttcatagcgtcgatggtctttacaatttggtatgtttttgcagtggctggcactcgttgttcctttccatgtttagtacttccttccagagcttttgtaaggcaggcctggtggtgacaatatctcagcatttgcttgtctgaaaggattttatttctctttcacttatgaagcttactgtggctggatatgaaattctgggttgaaaattcttttctttaagaatgttgaatactggtccccactctcttctggcttttagggtttctgctgagagatctgctgttagtgtgatgggttccccttgtgggtaacctgacctttctctctaaggtctggctgccattaacatttttttcttcatttcaaccttggtgaatctgatgattatgtatctggggttgctcttcttgaggaaaatgtttgtgttgttcgctgtatttcctgaatttgaatgttgacctgtctttctagattggggaagttctcccggataatatccttaagagtgtttccaacttggttccattctccccgtcactttcaggtgcaccaatcaaacgtagatttggcctttccatatagtcccatatttcttggaggctgtgttcatttcttttcactcttttttctctaatcttgtctttttgctttatttcattgagttgatctttgatctctggtatcatttcttccacttgatcgatttggcaattgatacttttgtatgcttcaagaagttcttgtgctatgtttttcagctccatcaggtcatttatgttcttctctaaactggttattctagttagcaattcatctaaccttttttcaaggttcctagcttccttggattgggttagaacatgctcctttagctcaaaggagtttgttattacccaccttctgaagcctgcttctgtcaattcatcaaactcattctccatccagttttgttctcttactggcaaaacgttgtgcctttggaggaggagaggtgttctgcgttttgaaattttcaacctttttgtgctggtttttcctcatcttcgtggatttatctacctttggtctttgatgttggtgactttcaaatggggtttctgtgtgtagatcctttttgttgatgttgatgctattcctttctgtttgttaattttccttctaacagtccgactcgtctgctgcaggtctgctggagtttgctggaggtccactccagaccctgtttgcctgggtatcaccagtggaggttgcagaacagcaaagattgctgcctgttccttcctctggaagcttcgtcctggaggccacctgccagatgccagtgagagctctcctgtatagatgtctgtcggcctctactgggggatgtcttccagtcaggatacacgggggttagggacccacctgaggaggcagcctgtcccttatcagagctcaaacactgttctgggagatcagatgctcttttaagagctgtcatgcagggacgtttaagtctcctgaagctgtgcccacagctgttccttcccccaagtgctctgtcccaaggagaagggggttttatctatatgtccctgacttgggcggctgcctttttttcagagatgacctgccaagagaggaaatatctagagaggcagcctggccacagcagccttgctgagctgtggtgggctctgcccagttcaaacttccatgtggctttgtttacatggtgagggtaaaactgtctactcaagcctcagcaatggtggacgctcctccccccaccaagcttgagcatcccaggtggatttcagactgctaacagtgagaatttcaagccagtggatcttagcttgctctgctccatgggagtgggacccaccaagccaggcaccagagggaatctcctgatctgccagttgtgaagaccatgcgaaaagcacagaatctgggccggagtgcactgttgttccgggtacagtctctcacagctccctttggctaggaaagggaaatcccctgaccccttgcatttcccgggtgaggcaatgccccattctgctttggctcaccctgcatgggctgcattcactgtccaaccagtcccaatgagatgaactggatacctctgttggaaatgcagaaatcacctgccttctgcatcaatctcgctgggaactgcagacaagagctgttcctattcagccaccttgccagcaagtcccctggttcttgttttttcattcattcagccactccatgtcttttgatgggagagtttagtccattgatattcagtgttattattgataagtaaagactcaccctgccattttgttatttgttttctggttgtttcttggtgttctcttctttctttctctcctttctgtcttcctttagtgaaggtgattttctcttctgatataattaagtttcttgtttcttattttttgtgtatccattgtatttttttgtttgaagttatcatgaggcttgcaaatactatgtaatatccaatcgctttaagctgataatagcttaatgttgtttgcatcaacaaataaacaattaaaaaaactaataaaaactttacaccttaacttcattcccttgctttttagcttattgttgcctctatttacatcttattgtattgtctatgtcttgaaaagttgtcatagtcattattttttattgattcatcatttagtctttctatttagcaagagtagtatacacaccacagttatggtgttataatattgtgtgtgtttctgtttacttactatgaccagtgagatatgtaccttcaggtgattacttattgttcattaacatccttttctttctgattgaagtactccctttagcatttcttgtgggacatgtctggtgttgaaatcactcatcttttgtttttctggaaaaatctttatttctccttcatacttaaaggatatttttactggataggctattctaggataaaagtttttttttccttcagtactttgaatatgtcatgtcaatctctcctggcatgtcaggtttccactgaaaaatctgctgcaagatttattggagctccactgtattaaatatgttatctgtttattttctcttgctgcctttaggattctttcttcatcctttgtatttgggagtttgactattaaatgcctgaggtagtcttctttgagttaaatctgcttggtgttgtataaccttcttctgcttagatattaatacctttctcttggtttcagaagttctatgatattatccctttgaatcaattttctaccccctatctctttctctgcctcctccttaaagtcaataactctcagatttgcccttttggggctgttttctagatcctgaggatgtgctttttggttatttattctttttttcctttgtctcctcttactgtataattttgaataccctgtcctcaaattcactaattgtttcttctggttgatcagttctgctattaaaagactttgatatgttcttcagtataccaattgcatttctcagcttcagaatttatgctggaaaccttttaattacttcagtctgttaaatttatctgatagaattctgaattccttctctgtgttatcttaaatttctttggcttcctcaacacagctactattttgaattctctgtcctaaagttcacatatagatatgtttctccaggattggtccctgattccttatttagttcatttggggaggtcatgttttcctgggtgctgttgatgctaatagatgttatttagtgtctgggcattgaagagtttggtatttattgttgtcttcattgtctgggcttgtttgcacccatccttctttggaaggctttccagatattcaaaagtacttgggtgctgtgttccaagctgtatctgttttgggatgcttccaaagcccactaacactttggttcctgaaaactagtaaaagtacctccttgatgaccttgggcaagaactgggagaatattctgtgctaccaggcagagacacttgttttcttcccttactttctcctaaacaaaagtagtctctctctctctctctttctctctctctctctctctctctctctctgttttgcatcacttgaagctggggatggagcgaaataagcattcttgtggccactgccactataactgagctgggtcagacttgtagccagcacagcactgggtctctcccaaagcttgcaataaccactcccttgctactgcctatgttcatttaaggccctagggttctacagtcagcagatggcaaggccagccagacctgtgtccttccctgcagggtgaagacttcccccaggcactgggtgaatccagaggtgctatctgggagtcagggactagattcaaaaaccatggaagcctacctggtattctattatactgtgactgaactggcactcaaaccataagatgcagtccttcccactcttccctctccttttcaaaggcagaggagcctctcctggtagctaccaccatcccaggccatggggagttctgccagactaccactgatgttctcttaaggcccacgggctcttcagtcagcttgtgatgaatgctgcctggcctgagactcacccttcagggcagtgggctcccctctgacccagggcaagtccagagatgctgactaagagtcaagtcctgaaatcagggatcccaggggactgcttgatgcactatccccccgtggccatgctggtaactaaggtgcaagacaaaattccctttacttttccatctgcttttctcaagcagaaggagttttgcactgtatccaccagagctggtcatatgctgaatctcacctgaaggcagaaagtctcagaggctcacccaaggccttgacgtagtaccaggtaatcgttactggttgtttagggacaaagggcttttcagttagtgggtaatgaatgctgacagactgagtctgtctttttttttttttttttttttttttgagacagagtctcgctctgtcgccaaggctggagtgcagtggcgcgatctcgcctcactgcaagctcccccttccgggttcacgccattctcctgcctcagcctcccgagtagctgggactacaggcgcccgccaccatgcctggctaattttttgtatttttagcagagacggggtttcaccttgttagccaggatggtctcaatctcctgacctcgtgatccgcccgcctcggcctcccaaaatgctgggattacaggcgtgagtcaccgcacgcggccctgagtccttccttttaaggcagcaggttcccttctggctcaaggtatgtctggaaatgttatctgggaactagggcctgaaacagtgacctcacaactctggtgccctttcctgctgtgactgagctggtatccaagatacaagacaaagtcctcctcattctttcctctcctctcctcatgcggaaagaagaggtctcttttaagactgccagctatgcagcctggggttaggggagggctgatgccaatattcccttgactgctccagctggtgtctcagtaggttgcaagctacccagtccactgtctctgggctcaattcagccctgggacttgcctaagagttgcaatccttatgtcatagactgtctttcaagtttacttgcagacataggttgctggagccctccgtgatgaggtttgcaggaaatcaagtcttgaccactaggatccacaattcccctctgactagggctggtttaaatgctccctctgtggacaggcatcagctgagtttggttcagttctcctttctgctataacggaatagcactgagttcagtgcctcactgttgctgtactcttcctcctgcagtgtggagttgctccctgcactgtgcagcttctgctggggtagtggcagaggggtagtattagcgattcgagactgcttttactatctcttcagcgcctctttcagcaatacagagttaaaaccaggtactgtgacagctcacctgatttttgcttcttatgaagatgtttttttttttctgtgtagatagttgttaaattactgtccttgcggggaagataattgatggagcttcccattctgccatcttactctgcctctttgtgagttagtttttaagataaggtgtaagttaaggtcaaggttcatcgttgcctatgggtatccagttgttctagtatcatttattgaaaagactacccttcattgatttgtgtttgcacctttaccaaaagtcagttgcctatgcacctattcttctgccaaaccacactgctttgattactgtggctatagtaaaccttaacatgatatgaagtgattcttcctgctttgttcttctttttgaaattgctttagctattctagaacctgtgcattttcatagaaattttagaatatgtctatgtttatgtctatgtctacaaaagcttgaaattttaataagaattacattaaatctatagaccaattcagagagaattgacatcttttatatactgagtttttcattctgtgagcgtgatatgtctctccatttctttttttatgttcttcatcagtagtttataattttaagcatatagaacttgtacatattttaagtatatacctaaatattttattttctttctaacaattgtaaatgatattgtgcttttaattttattttccacctgttcatagtatatagaagtgaaattaacttttgtatgttgatttcgtatcttccaaacttactgaacacacttattagttctagaggtttttttatagacttcaatggattttctatgtaaacaatcatatcatctgcaaatagggacaattttattcctttccttccaactgcataccttttatttctttttcttgtcttattgtgctgactaaaacttcccgcacagtgttaagaaagagtggtgagagcacacatctttcccagttttagggggaaagcattcagtctttcaccatttaatatgatgttaacaataggattttttacatgttctttatcaagttgaagtaatttctctctattgctaactggctcagagtttttatcatcaatatctgtggaattttgtcaaatgtgccttccatatatgttaatatgatcacgatttttcttctttcacctgttgataaatattgcacctactatgtacccacaaacaattaaaaataaaaaaattaaaatgatggattactttaattgagccaaatgttcaaccagtcttgcatacctggaataaatcacactttgtcattgtatgtaatttcttttatacattgttggattaggtttgccaaagttttatcaaaaatttctacttctaagttcttgatagatattggtctgtatttttcttattttatactatctttgtctggttttggtagcagggtaatactggccttgtaaaattaggaaatgttatatctttgaatttttggaaggcatcatgtagaatttattttaattatgttttaagtgtttagtagcagggattattcatcgtggttgagattttagagtgtgtgatttttaggaaactggtccatttcttataactggtaaaatttatgagtgtaaagttattcatattcctcccttattaccctttcattaactgcaagatctgtagtgctatctcctgtttcattccccatattggttacttgtgcaatctgtttttgtttttgtcagccttgctagaggtttatcaagcttataatttgtttgagaatcagcttttaattgtatcaattttctccaatgtttttctgttttcgacttcattgatttctccctttctctgtattatttcataatctttctgcatgctttgtgtttgtcttttttcttttttctagcttgttgaaagtattagaatattaatttgagacttgcttcttgtttaatgtaatgatttcatgctatgaacttctctctgagcactgctttagctgtatctcctatattttgatatgtttgttttattgttattttccttagagactttctctttgactgatgggctatataaaggtgttttgtttaattttgaagtatttggatattttcctgttttgttttattattgatttctaatttgatttcattattgtcagagaacatatctgtatcatttcaattattttatatgtattgaggtgtcttatgatgctgggtatggtatatcttgatgaatgttcaatgaatgcttaaaaatgtgtgttctgctgttctcatgtggagtgttatatctatataaattagatcctgttggtttattgtattgttcagctcctttatatctttgatgactttctatctagtagttctatcagttgctatgaagaatatgtgaaagtccccaactatacagatccacaagtatagctggggacttcaacatactatttctccctttgggtctatcagattttgcttcatgcatttgcttcatttatttgttttggggcactattgtttaatccatgcacatttaggatcattatgtcttcagggtgaattgatccttttatcattatttaaagtccctctatctctagtaatttatttgccctgaagttgattggatactatgtattaattcctacctttttaaaattagtatttacttggtgtgtctttttccattcttttatgtttaacctacccctgttactgaagttgacaagtgtttcttgcaaacagtatatcattgggtaatgtttgtttgtttccttccagtctctgtcttttgattcctgtatttagactgtttacatttaaggttattattgatatgttagaacttaagtctgccattttattatttgttttccgtttgtttcctctggctctcattcctctatttctcttttcttgccttcctgttggttacttgaacatattttagaattctatcttgagtcatttatagtgtttttgtttttgagtgcatattttgtatagttttcatagaggttgctgtaggtattacaatacacatatgtgacttatcacagtctcctggtttcaacattttaccacttttagtatagtggggaaaccatacttacattaaggtccctttacctttcccactttttaaatactattgcctttaacatcagataatgctattttttgtttcaatcatcaactataatttataaactataaactcacaaggaaaaagggaatttattgcacttacccacatttatttttaacagctttagtaagaaatcatacagataccatataattcactcatttaaagtgtaaaattcgatgtttttagtataacagggttatgcaacattcaccctgccttagtttatttctgttgctataacaaaatacctgagactgagtacattatcaagacaagaaatttacttagctcacagttctggaggctggaaaattcaagatcaggtggctgcatctggtgagagccttgtgctgcttcatagtttagcagaaaagtggaaggggaattggttatgtgctaagagagaggagacaaaggaggctgacccgttttataacacaacctgtttttgcaggaactgattcagtttcatgaggactaacccagtctcctgagaaagagggtaatccatcttaatgacctaatcaccacttaaaggccccacctctcaacatggttacaatggcattaaatttcaacatgagttatggcagggagaaaacacatccaaaacatagcacactacaattatttttagaatattgttccctctagaaataaatcccatatccattagcagttactcttcattcccccaaattctccctccctgccagccccaggcaaccaccaagatattttttgtctctattgatttgcctgatctggatatttcacatatatgaaataaaatcatttgtagtcactttgttactgggttctttcacttagtataatgtttttgaggtagcatgtatcactatcttattcctttctactgctgaaaaatattcagttgtactgatacactaccttttacttacccatttatccattggtggacatttgggttctttctacttggctataataaataatgcctatacaaacatctgtgtataagtttttatgtgcatgtaagcttttatttctatttgttatgaatctaggagtggaattactgagtcatatcaaatcctttccccatttataaattgggttgtttgtctttttcttattgagatgtgagagttctttatatattctggataaaattcccttgttgtacatattacttgtaaatattttcacattatatgggttgtcttttaactttactgatgatattgcttgcagcacaaaatatttaaaatcgatgaagtccaatttatctgtttttcttttattgagtgtgctcttggtgtcatatttaagaaaccataggctaactcaaagtcatgaagacttactcttatgttttattataagagttttattgttttcactcttacatttaggtctgtcatctattttgagttgattttttgtgtgtatgatgtgaagaagttcactcaatttcatttgtttgtatgctggttttcactcttccagtgtcatttgttgaaaagactattttttgctctatggaattctctttgaacttttgttgaaaatcaggtgaccacaaatgtaattgtgtctttgtggattctgagttctattccattgatccacaagtctcgccctatgccactatctgtcttaatgatgctttgtaatgagttttgaaactgagaattctgagtccttcaactttatttttattttccaagggtactttgactggtctgtgtccctttaatttaatttccacataaatgtatcgatgtgttaaactgcagatacattgggggagggagttggggagaatgtgaagtgactaccaatgggcaagggatttctttagtgggtggtttaaatgttctaaaatctattgtggtgatggttgcacaattctggatatacacaaaaacatactgaactgtacactttaaatgagttcagtgtatggcatgtaaattatatctcaataaagcttattaatgaaataaatctaataatgaaatgtgaagctctcatcacaaatttaaaataattaagtaattaaagaagccaaatattatatccaaaactcattggaacactcaagttcaatatgaaatcaaatgatagtgtccaaactcatcatgaagggcctaaactggctataatcgatgtttgtaaccaaaattgagaaatggcagtacagtacatagcatgatttctaacagaccaaaattcagtagtcagctatgtttaaattagaaaagttttgtaatattcataaccactgttttctagtgtcactctttttttgctagatctaaatgtattcatagtttcatcattaataaattcgttcatttattgtactcctggaaaacaaacaagtatttttatgctcattataataaaaacataatggaaattcaatttactaaaaacctaaacctcttcatatttaaaaatttatttgaaacattgaagtaattgctaacaaaaacctaaagaagctatcaagttaaaaagataactttttatacttctattttaagtttaggggtacaggtgcaggtttgttacataggcaaatgtgtgtcatggaggtttgttgaagagattattttatcacacgggtattaagcctagtacccattagttatttttcctgatcctctccctcctcccacccttcaccctctaataggtcccagtgtgtgttgttcccctcttgtatgcccatgtgttctcatcatttagctcccacgtataagtgagaacatgtggtatttggttttctgttcctgggttagttttctaagcataatggcctccagctccatacatgtccctgcaaaggacattatttcattcttttttatggctgcatagtagtccatggtgtatttgtgccacattttctttatcccatctatgattgatgaacatctaggttgattccatgtctttgctgttgtgaatagtgctgcaattaacaaatgtttgcaggtgtctttataatagaatgatttacattcctttggttatatacacagtaataggattgctgggtcgaatggtacttccgtctttagtaggtctttgaggaattgtcacactgtcttccacaatggttgaactaatttatactctcataaacactgtataagcgttcctttttctccacaacctcacagcatctgttattttttttgatttcgtaataattgttattctgactggtgtgacatggtatctcattgtggttttgatttgcatttctctaatgataggtgatgttgagctttttttaatgtgattgttggccactatatttcttcttttgagaattgtctgttcatgtcctttgcccactttttaatggtgttgttttatttcttctaaatttatttaagttccttgcagatgctggatattagacctttgtcagatgcatagtttgcaattttttcccattctgtaggttgtctgtctactctattggtggtgtttgtttgtttatttgttttgttgtgtggaagctctttagtttaattaaatcccacttgtcaatttttgcttttgttgggattgcttttggtgtctttgttgtaaaatctttgcctgttcctatttcaaggatgtcattgcctatgttgtcttttagggtttttgtagtcttgggtattacatttaagtctttatccatcttgagttaatttttctatatgatataaggaaggggtccagtttcagtcttctgagtatcgctagcaagttatcccagcaccatttattgaacacggaatcctttccctattgattgttcttgtcaggtttgtcaaagatcagatatttttagttgtgcagtcttatttctgggttctgtattctattccattggtctatgccagtaccatgctgtttggttatttagccctgtagtatagtttgaagtcgggtagcatgatgcctccagctttgttctttttgcttaggattgccttggctattgggtgttttttggttccatatgaattttaaaatagttttgttctagttctgtgaagaatgtgaattgtaatttaatgggaatagcattgaatctacaaattgctttggacagtatggccattttaacgatagtgattcttcctttccatgatcatggggtgtttttccatttgttcgtttcatctctgatttctttgagcagtggtttgtagttctccttgtaaagatctttcacctccccagtttgctctagtcctaggtattttgttgtttttgtggcaactgtaaatgaaagtttattcatgacaggtcttggcttgactgttgttggtgtataataatgctagcgatttttgcacattgattttgcatcctgagactttgctgaagttgcttatcagtttaagtagctttttggctgagatgatggggtttttgagagatagaatcatgtcacctgcaaacaaggatagtttgacttcctctcttcctatttgaatgccctttatttctttctcttgcctgattgccttggccagaacttctaatactatgttgaataggagtggtgagatggggcatctttgtcttgtgccagttttcaaggggaataattccagcttttgtccattcagtgtgatgtaggctgtgagtttgtcatatatgtttcttattctttgaggtaagttcattcaatacttagcttattgagagtttttaacacgaagggataaagataattttaatttttcatatgtcagtgaaattatgtgacatacacatgatggtacatatgccatatattcgccagtcttgtcaacattttaagcaaggaggctaaattattccacagatcagctgaatgattcatatctgcccttgtttgcctaaaatggaagctgcaaggtcatattttctattcatcctggatactcataaagtccttttcaatccccacacaggtcctttgcaggggttcacctgactatactcaatgcagtgttccacttctctgtagtcaagaaagaaaaacgaaatgtcatccattcaccactgcctaagaaagacatagcctaaatggacagcaaatgtccagttatataaaaaacccacacagctgcactgagccctgggaataatgccagtattgctaatagagcaatgcttctcaatgtgtggatacactaccattggtggtccacaagaaaatttgcggggacacactggcaaatgttttaatagttatgtatttgttttcttgtgtactaagaaaaataaatacttagcacacaaaatctgtgttctcaaaaatattactttttgaggatgggtaaaaattatggtattattagtaattcctttacttagaatgctcatccatctctcttgtttgtctttgcctcatgagtaagttcttccctgacccaactttcagacagttttagttggttctccctctggtccccataatgtttttcacatatctcatttatatcacatttcagattacagtgtaatttttataagcacacttatttttattagagtgtgagcttctcaagaatcagagtcaaatctttgtatccttagagcctgatacagaggttggacccttgtagtgctcaattaatatttgtggaattaatgcatatgaattacaactgtggtcaggataattacgttctacaagcattgatctagtagctatttctcagttggaggcacgatggcagggtatctcagggagaactgaaaatttaaaactacaagacaggaaaccaagcataattaattctctatttgattaattacattagcaaaattttatatgctgagttttcttataataatagatttctgatctaagattcaaaagcagaattactgaaaagaaataaaggttgaaagaactgaagtttaattaagagagcagaggctctggaatcaaactgttctgagtttgaattcttactcaacaattactagctttatcatctgtatactgaggaccagagataattcatatgaagcctaacaaagtactttatacatggtaagatcctgataagtgcaagctgttattattaatttaaagcatatcttactaattacatacaactagtaattctgtgaggtctagcctaagagaaaaatataaagaagtccagttctcccctcttactttgttaccattcttactccaaccctctctcatgatagcattatgatcattaccttccagacttatgccaaccaccagtttaaagcacacctggtctctctctccaaagttcctggtataaatcttccctatacaaggaaataaatcattttctaattcatactttcctggtggcaaggagataattgtttaaatttaaaaagttttttcatctaatttctactgggttagagtaaatcagaatgctgtcaagccaggaaagtacttaattaagtagagaaggtgacaatgagtcagcgtactttgttggaaaaattacaggccaaaagtttaagtaggagaccagatttctagtctctactttgctaataactcacttagaaactttaggtgagttgtttaactgctctagcctcaacttcgttacctgaagatggtaagttctatgccgccaagacactggcttatattttcaaaaaaataaggctgtatcccccactcactcctgaaaccaaaataaattccagaggactgaacaaatatttaactataaaatgtcaaactatataatttataaagagaagtgtaaatggatttgtttatacctgtggaatagagaaactcttctaaaggaaaacacaaccagaagtaataaaggaaaataataagactacataaaagcttaagtcttctctctagaaaaaaatatcactattaagagctgaaagaatgaaagagaaaatccagtagaaaaagaaaggatatggtcgaaaaattcacagacaggaaatacaaatggtcatcaaacatatgaaaaaatgttcagcttcactcgtaattaaagatatgcaaatcaaaaaaagccatttcaatctattcaatttttaaaaatgaataatttttcaggtaccaaatgctgtaatgtcaaagtgagcatgcttctgtgtcagagtataaattggtgctgctctccagtgccagttcttgccacctgtctctgaagtacttctttcccaatcattctcagagatgaccctcttccactattcctattttctgatttggcgtcccacagccactttatagtctgggacactatgtgcaaataggtacttttttccatcacacatcatgtcacctcctctgctttctggaaagttcaaagttccttcaatatggctctttttctctctcctactctttggagtctcttctctaataaataagttctacaaatttcaagaacctagccagtgtaattttcaaatggtcattagcagttggctgcctggaagaaacgaagacttgagtaagctcttaaaatgtaaacaaagcaaaaattaatattcaagacattaatcttaccacagttattttaaagatgaaattaagataaccaaatacaatagaatgctacatttattgacaaaaattagcataaactcacaaaacaatgtttctgttttcaagagctatacaaatattaatatttttcacagagcaaaacccatctcacaaaccaaaaaagcatgaaccatatatattttattaccttttttatctccagtgtgggccttattcagaagaaattaagtgctaaatggtatccaatcttacaataaatttagaagtaaactagaacataaaaacaaataggaaactgaaggagtaattatattttcccttaaacatgaattgatcatgtgtctgtatatgaagtagactaaacaatatatatattccaacaagtaaactatttagagagcatatttttaaaaatattatcttatttccacttaggcaatttaaccctgaaaccaagggaaggagttccaaagatatgcttagtttattggaaataatgaaaatatgtaaatgtggatttatactatcgtcattaaaatttgtgagaattgagcatgtccatttgcttgaattgttactcatttcaatataaaatataatctttttaggttttgagtaggtgtaaatgattgaagcatgtcagctattgtttaacaaaggaagtgagcatagactgaataaaaaacggatagaaataaacaaacaaaaaagaatgattccttgaaaaacaagtaaatgtgagaatgtcaccatgtccttagaaggtaagaacacacacacacagacagacacacacacacacatatatatgatgcctccaaatatgactcttaagacataaattttaacgattcctccttagtgaatctccctttctttcttccttcctgtactctagctttgctgtgcattctagagcattttaaaatttaatacctttgttgaagagccatttgtccttttatcctcttaaaggactatacagttaatgttagcaatagcaaagattgccaattccccatacaagaaaatctacttgagctctgctacttcatcagagtgttcatatctacactttgaggattaaagacaactagttttaacatcattttatctcaccttaaatgtgtctaagttaaagcaagctccagttgatggcccatgtgtttcaaataatttacaacaaaacgaaacaattcgtaggttatatgaagcttgttataaaatgataagtaaggctctaagtgaatggataaagcccaaaacaggaaaaggaaaaaaaaaatcctagcataacacaaactgaagaaaatcaattgttacagacatctaaaaaatcgcatttaactttagcttttggttaaaatgccatcagtttactaaattgaatatttttcttaataaagatgttggtttctaacacacaacctatttgacaggtcaccactattctctcatgaagggtgattatttctaatcaaccctcactagtgaacagttggactacaccgaaaactgatctattcttgaaaataggctcttgtctcatataggcagcctggggcatttatcagttcttgaattcttgtttcatttctttttgtaagagtaaccagcattagtgaactttctaaggagaaaaagcctgaacattaaggccaattaaaataaacaaagtgaaaatataattgctttaaactaaagatgtcattttttcaatgtgccacaatagccgcaaaactttagaagtgtcacaatctacatttccatattttaaaagctatgaattaatatctgtgcttctataagttgaggatgaaggttaaacgttcctatcatattaagattttaaaagtctatttcatgcaaaaaaacatagatatcaactataccaaaagtataaattaagttcaatagataggatttagtaaataccctagaaattttctaagagagtagatattaggtgctcttaccacaaaacaataatttttttgttgttgaatatgttgacttgcttgaccgtagtaatcatttcattatatgtatatcaaaacatcatgttgtacatcttaatatatacaattaatcttttaattttaaacaataactatgtatataaataaatttaagggaagctgaaatcttataaagtaagaaagtttgaaactcttttcaagtaaatgatgacacctactggatgttagaaatcttcaaataacatttaaccaataatgaatctcatccgcaatttttatctgaaaacctctttgctggcaagggaaagaagaaaacatgggcaagcatttggacgttcaagattaaaaactcacattcaccagacttactttagaccaaaaaacaaataaaggaataaggtaaaaagtagtttttctcttctgaattttctactttcttgaggtatagaaaactgactagagaatacaagtttaagatcatagatgagtgaggatccaatgaatcagtaaaaagatatatctgaagtaggttgacagccagagtttcatcttgagttttaaggtcattgagatggaacataattcgtgtttaccaaatgtgtcatttagtcattaacatttctgtataaactgtgtaattgctgatatcacaaccgtagataaaatttttagtaaaaaagtgaaaaaaactgcctgattttttttttttttttttttttttgagactgcgtcttgctctgtcacccaggctggagtgcagtggcatgatctcggctcattgcaacctctgcctcccaggttcaagcgattctcctgccgcagcctcccaagtagctgagattacaggcatccaccaccacaccccgctaatttttgtatttttggtagagatggggtttcaccatgttggccatgttgatctcgaactcttcacctcaggtgatccacccgcctcagcgtcccaaagagctgggattacagacgcgagccaccacacccagccaactgcttaaattttaatagatgatctttcgcaagtcatttaagctctctgggcttgtgtttattcatctgtattccaagggtattgaaactagaaaatctctattagtatctgctaaacttgaatgtctgaaagcctaaaaatagcattcttttaaattgttactttaaaagtcggtagaaattttacaaatagaaacataaaatgtattatattccttttacccctagaaagcagctcaatttacttttaccactggaaaaataatctatctgtcatatcagtggctactctttaattcagtattttattagtctttggcctgctgcaaataaacataggacataggaagatttgggtcaccagaattacagtttttccagagtcagtctcagctaagtggcatcatcaattcaaataaatttctgatatcaatcttaaacaaggctcagaaataagtgtattgatgtatttggctcactgtagacttggatttattttaccctctgaaaataccaacaaaaaaaatctaaaacactgtattctaataatatgatagaattcttgcattatttgctgacaatagtatatagttttccaattttttattttattaaaatacaacaggaataataatggtgttgcatgaggtcaaaattagagatattttaacagagaaaataaagtatttcttactagtcaatcagtatttttgagatcccattgcatgcaaagtagtgtatctagaatgcttttaattaatcatatatatatataattttaaactatgaatatacagaacatttgaagacctgttttatcttggctgtttagcattccttttctcataaatacataatattttcttttggattctctgtcaatatatcttaatgttggtgcctttaatccataaattttcatatcttcctgtgtcatttttaactggttactaaatggacacgttacagttcctgtaaattttgggagtggtagtaggcatgcttaatagccaggtaaaattagggaattctgtggagaattgtcaggcaatcaattttcctagtcattaataaattaaaaagagaaacaagccaacgtaatcttagaaaaaaatagtccagtaaaaagtctcactttgacaattacacaaaaataacctttttactctggaataatttatcaattttagaaaaatatattggaaaagtagtaaattctacagaaggtatgtagagtgtgatgtgctgagtaaatatttaggcaaaaggaaataagtatatacaagtttgacccaatttgaagaagtttgatggagtggttgggaaaaaaaggaaaaatcaagcttgcttgtgtcctatgagtagtacaatctaaattgtatagtataacagcagggaagaatttcttagggctaaaataattgaagaaggcttttgtcaaagaggtgatatttggattgggtctaaacagtttggtaaacatttgataggtgaagatatttgagaatggggctgcagtcagaggtaataatactgcaaaggcaaagagcctaaacaggtttgctaatgtaaaggaccgctctggttaatggttagaaggaagaacatgaggaaatgggggattggggtcaagaaacagaagaatgtttcacacttagaaaatgttcttttgcatgcatgactattttttcaatttaataagatataaatcacagttgcaacacgttagccttcaagaagaaaaaactggccaaaaaagaaaattgctgacaaatttaagaggagttttagagctcactgacctgcacattatgctttgcttctctaagctttaccttccaaggctcctcaagataatttgtttcaatccacttggactaggcactatgttccctgaacaagtacaaccttttcctgccgctgcatttgctgtaatgtaacagtctaccgaactgttcacaggcaagccaaattccacttcctcaatcaaaccctttgccaagttaccttagtcctaaaagatccttccctcctgttttattattgaatttagattgcaccattcagataatacaatcagctttgatttgtaaataggtatgcatctgtttgctcaatcctacaaaattataaaattccttaaagacagaagctgtgtaatgcaactttgcatgctacagggtttcgcattttcataagctagtctacaaaaacaaaatccgactcacaaaataatgctaaataagaatttgttgaatggatgcattccactgctgacacattttcattcccttcatttttcttcttatccttatgaggcaatccttatattaaaatcaatttttatgcttatcttctaactgttggagaataaaatgattgaaacatatttaagttcacccaggaatgcttttaccataagggcaaaaagtgacatcaggaacatctagggattatcccaataactgtggacgaaggaagcaatttaaatatctttctgatttacttacttgaattagaatgcagtatgaagttgggggaaggaaactgagcagcagtcacgcaggctcattctacctgatctatgtaattccatactatcagtgctggggaagaatgggcaataataataataataatgatataaatatataacaaaataaaaataatatagcaatagtaaatataataattacaatgggttattctgttaggctgtatttttgcttgaagggatggtttggcactctgtagcagatacagtgtttatctcttaaactgattattccaaattttttaacctacataaacacaaatgaattcttcctaaagtaactgttcaaaaggttaaatttcttttttgattaaccctccaggataaggatttgggttgttgtttgggagcacttttatacacaggtagctcttacaacaaccacatcaaggcgcctctgagaaagggcggtggggaattagatcctctattttaatcatatttattcccaagtaatttattcatcaatctccacctcaaccctgaaaactttaggtctcagaaactgacactgaaaggcacctataagcctctcttacagtcgaaagtcacctaaatatggctgggactagagtgacgctatggagacattctcctttggcaaaaattttaaagggccgcctagaaactcagtaatgaagatacttaatatttttagacaatctttttaaatatcaaaattcttgcaaaaaagtccatgatgaacaaaatatcaaaaatttaaataaagacaggatcataccctgcacttgcgtgactcacctcactcgcctcatcctagtctcctgggtttttgtcacaagcttaaattttgtgcctgaggcgagtacctcaatggctttatgctagtctaggttctgagtcctaaacactttcgtggatagcaccttcttgagtcctttcactaaatgcaaccttcagattaaaaatctattctcagtgtttttcatttggatagacctctgctattacacatttccctcggagtcccgctgaattcttcgtatacctcctccaagtgggataacggtatagctcccggttttgtcgctactctacacctgcggaaaacacgccattttggcaccctcctcttgccagcaccacagttctgctttggcaggatgttcccacaccagagaaacatctccactcttttgcgctttctgaatgaatgttcttgtcggttcaacaccatcccgccaaaggtggcagggaaagaccggagcccagactcaactggtcttaaaagcacttatcccgctaggaatagggaagggtggcgggtttggaggctgtgaagaaagcaactgttgtggctttcgcctgtcattataacataaaagaaaaaaaaactgatcaagtcagctctggctttcctgctgttcttattcctgatcgcttagcccttgctaagttcgcgtgctccgccactacaccagcggttagagccgacagggaacgagggcttcgggcaagttcgcgggccacgcccctcaaagccggctgcctcttcttattggcctgagagcctgtcactccaatgtggctcccactccggttaaccattcacgtagtttggttgcgtcttggcgtgtttaatgttgccaataacgagggattttttttttttccagaggagagtacaggtcgtgctgcagttagttcattgaaaactcatttgctcttggagcagtcaggcagtgactgccttcggctttttttctgctgactaagatctcctatagagagctacaacaatgcccaaaagaaaggtaagtgaaatggaaagacagacggggaatgagctgctgagttacctatttcctaataggaagaatttatttgtttgtttggttttttttaaagctttttggcttcttccattttgtgatgtaatgaaacggaaaggggtagaagggcaaagagcagtcggtgtaaggtttaggatggtcttgcatgcaactggtagttcacttttggagtgttctgtttaaggagagaatctcttgaaaggtgtctccatgctgaattacaaacagccatagcgctgggctgtcgcttcctaccccaacccccttcctccgcttaccctattggagaacacttctcccaaccatacttcagtttcctcctctgccaccggcttttctcggggaaccgtcccgtctggggaacgaaagccatggctttctcctgtatttgcctttgttcttcccgttttcttttttcttttttttttttccttccctcctcctccacttcttgtcaggccagatggctatgcaatggtaatcctgtgccattaggcggcgcagacttcaaactgtcctagagaacagagattcaccgctgtaattagaaactttaggggtgagaaagctggacctttccaagctctttagctaaagatgggaagattataaggagacagcgtcggataaacttgctgatgttggggtagcatggatttgttcactttagtagtgcagaattgatctgagcctttcgagctccacaggtcttctgcaaaccctcacttcacaattcctggctcctcgcagacaggaaacaagttcacgctcggcgtttttttcttagtcccctagaagtgaaatcgaacgctgtttcattgcttggtaaaaccgtataacactatgctaagacattatgattgtttttggattattcctataaacaactccgccttccttattcctaaaacataggaataatactgaaattcccccgtgctctgtggctgtctgaatcgtgcaatagcttgataattctcaggctaaagggctgctcagatatggaaaacaactgtttctaatcaccatccccccttcctgagattcccgccactgtgcttttctatacttgtgcagtaggtcttgctgttttccagagctgacagcaaccttaaagcaggtagtggcgggaagttttaaaatcggcggccagtttcttagaataaagcattgactttgtaacaaagaggtctccccaagaaaacactgtgggggctgtaattcttgcatgcaaaacttggagaaaatagtccagaatcagtggagaggataagataggtacaattgcatggcaaacataaggcaagaaagcgaaattgcatgaagctccgccttcatttgacccacccccacatttttggcttttacattatctaaagcaggtggatttcaaaattacaaaggtttgcttttaggagatgcaatttacacaaaaggatgaaattaactatcaattgtgtaaaagtatgtcttgtgcatgcacttgcatcttggtgcacattagtaaaacagcagtatgtagcatggttcctaagaaacaacacgtgtctacttgagcaggaacccaggagaaagtaataagcaattatattgaaatttgtaatccgcaggcagtattttctgatttatgtgtttatatcaatgaccttatttctgtgtggttttctcctctgtgtaggctgcaggtcaaggtgatatgaggcaggaggtgagtttctttagtcttagcatctattaggaaaaaccactcgttttataaacttgacataagcagctaaaaaatagatgctggttggtatatttgtacaatatgagttccaatatggtataccagtgggatctctcaaaaatatatatccgaatttcagaagagaggactttttaaaattgccattcagaataaaagaaaaggctttttcacttttttttatagaaatgatggtacggaaatattcttgacaatagagatgtgctaatattttatttgggtgttttgtgggttagactatgatttggtgtgtgtactttacaggcttacatgttgcttactttagaaagttgaggctctaaatgactgttcacatatgtgaaacatttcttaaagtactatatagtttttgttattgcattaaatatatattgttctaactcctagagtatgccatcttctatatgtcctacaaagcgagaatcattgttgtgcgacaattatattaaagaaacctctcagtttacctttatggccttgttaatctaatattttggtcaatgcatattattaattttaatctaattaatgcacaataaaaatatactgagtgtgaaaaaaatgtatatatagtaagtattaaaaactgcaagcttcttcgaatttaagaccttattgtgcttgttcagatgtggagagaacttcttccttttaagcaaaataattgctttgtcatttggcaagaaaaggctatattttcatttctaaatgtgctccttgttactagctactgtgttaatttagcctagctgcttaagcttaatttgggactttttccttagtatgtaaagtgttcagaggacggaaaaatcaaaacttatatttctcttgtattttctaaccaaattcacaattacttaatgacaatatttatgtattgttacaccaaatattttgacctcaataaaaataattctagctttttgtatccataattctcttaacagatttttgtttttaacttatagccaaagagaagatctgccaggttgtctgctgtaagtaatcttttcaaaaagcagcccatgtattgtgaaacgtcattttaaaatttagggaatcctaaaatattcaatacacgatttatttttgaagttttaagaaaaactttcacaccaaggaaatgtattttttttcctaatactcatttattttaattcagaggttggatttcatttttagcgttctttcttcaaatatgatttttttccttttcttttcttttcccacaacttgaagcagatgcttgtgccagttacaccagaggtgaagcctaaaagaacatcaagttcaagggtaaatattcaacgtagaatattgaaataaatttgctttttttttcaaaaataatttttgaaatggcatacagctgatcattttactttgcttatattttgttcagttagtaatatattatattctatcatatgatacatgtaaaccccttgggtggggattatttgttctgttttgtgattgtccacagtgttttgacattttcactgggtagagacaaaacaatttcagttggataggcccattaaatgtacatgcctttgctatcatatagtgacaatactgtttccctgggaaaacaaaaggtgaaaacagtagtaaccccaaagttgtgctttgtaataaaagtagtaactaacatttgataatattttacagttggcaaagtatataagattatatataattatatatataatatatgtaagatgtatttgcatatgttaattttaaatggacacaattgattttgtatggacttatatactctggtgttatggctaaaggcatgtagaaatagatataatctcaatatttagtttactgctaattgcttaatacataagaatattgattgaattcctgaaatcataaaaggttaaagctatgagaaacattagagagcatctaatcctatcactttgtagttgaagaaagtataaactgtcattatgttcataaatgaaatcctttattaaaaaatattgctaaacttagggaaattgaagttttagtaataattgatatatttaatggtgacaaaagaaaagaaggtttttttttctgcattttacttttcaagtccactattatataaggttaaatattcaacttactagtttttaaaacagtaaatacagcatattttcttttaaaaagaaaagtaaggccagacgtggtggcttacacctgtaatctgagtactctggaaggttgagatgggcagattgcttgaacgtaggagtttgagaccagcctgggcaacatagaaaatcaccatcaccacagaaaatacaaaaattagccgggcatgcctgtagtcccagctgcttgggaggctgttgtgggaggattgcttgagcctgggaggaggaggttgcagtgagcagagattgcctcactccagcctgggcgacagagggagtccctgtctcaaaaaaaaaaaaaaaaacggaaaaaaaagaaaagaaaagaaaaatagggctagactaaaacatatactatataaccatagactttaccctccttggctctgtttctcatgtgttaaaagagtaataacttatatctaaattacaaattacagtttctaaagcatttttttcatgtgttttctcattttctccttgtaacatccccgtgaggtgggtggtattactctctttttatatatgaaaataacagcctcaaagatacttatgcctttgctcaagatcacatcacataagtggcagatctagaattcaaacacaggttttccggcccctcaatccagtggtctttctattacatacacaggtaggcaaaaattttcttggtgaagtcgtcatgaatcagggcattccaaacttgtagatacaaagattgaaacacttacatcaccataaggtcttttaaaaatatatctaaattgttgttctcactaacagcatttctcttaattattaccaatggaggcgtaacgatcaacaaaaccctgttccttattaattagacttgacagaaataaactgaccctctctagacagagggaattaattgatcagtctaacctgatgccagcagtttgtccttggcagcaactagtcagcattctaactggttgcctctcatctatatcactcaacttaaaaggaaatttattttgtttatatcaagggaacattgttcatttttaatcctgctttaggcttacaatgaaatttacaatgaagatattatatgataattttgttgataccagatttatatgtgatactttaaagagtttgcataaattattacaacagctggtaaaataattgtgaccatttaatcaacacagcagttaaattgtatatttactttcattgttttatattgcttggcagaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacaga

SEQ ID NO: 5754 - DNA, 104746 bp, human; identical to SEQ ID NO: 4770

SEQ ID NO: 5755 - DNA, 785175 bp, human
tcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccacatgttgaatgtatagatttcagctttaactaccaacttgattataatagacaaggagagggtgacatataaataaagccgtttcttatggcatctggccatttggtttggatccagtacaaaactgtggtttaatcagtgattaaaaatttaagtaaaaagttaactgatagtttccacaaatggtttggtacgtctagcaagaatctgccacttttaagaagtatgctttcgagaaaaaaaaaaacacttatctctgttagtagtaacaccttgattatattcttctcttccctttagccatttgtcctgattcatcttttatgttttacttgctttgacaaggtaactagatagttatgagatcgtatcattttcagttcctagctaacttcactgttccggttcctagctaacttcactgttccgtgttgaacatagcttgatacggtagaacaagatttgaatccaagagtttgttaatattaacatgaattttctttttttgctcaaacataacttttgagccttacgtgattttacaagcagatgtgtcagagttaacaaaaacaaatttaggaagacattgtggcacattttaaggcaagcaagttgaccaaacagtaagatttagtaagcttttcaggaaagaattcatctgggattcttagaagtttgctagtaagatacaactttacttagatgaaatttttttattttgagtattatgttaataatctctgaactagtccttaatttgtgtgtgtatatgagtgtaaaggagttgtggtatgggattataaaagagagccatatggtgatagaaattatttgtgtaggtgatcttggggcataggggttcttaaactcctgaaattgtatgaaaatatttgagtgtatatgggtacatttatttttctgggccccatggctttcatcagtttttcaaaggcatccattacctatagaagagtaagaactatggcattacaaaagatagaaagtaaaggaaagaatagttgattccactctaagttactgagtagggaagaaggggaaatggcattgaccacacaggtgattgatattgaaacgaattcttctagtggtaaaaaagaagttaactactcaatgtctacatagattaaaatttccgctacagaggaaaattaattcagtcgctccagtataatggattcataaggtataaggcttgtgtagtttggttgttttcatttagttcctcagaattctggaaaaatggaaatggaacacatattttcttttctttttttttttttgggacgaagtctcgctctgttgccatggctggagtccagtggcgcgatcttggctcactgcaacctctgcctcccgggttcaagtgattctcctgcctcagcctcctgagtagctgggattacaggcacgtgccaccacacccagctaatttttgtatttttagtagagacgggatttcaccatgttggtcagcctggaaagcagattttctatagagaggaactgctttcatttatatcctcaactttttaatgagtattagtgagaaatttttcagagtggcatttcaacactataatgatttctatttaagattacttaaataaaaatttaatggaattcacttcagtttttttcatataagcatcctcataatgacccttttgttttgattcttttaaaataaggcattcctgtcttggactcatcacattttgaataatgcattagtagtagagttttggattttatgtaactattttggttaggcccagattgcaacatgtcatcaaacagcatgaatcttagattaatttgtaatttgatgtcaaccatggaatgcattttgttaaattgagtagaagagaaagctctataaatgttgtgaaggaactacatcttgaatcctacttatttaaggcagtgacttaaccattaagagaggccaatgttgatgcagaacaccgcaccccacaccacacggtagtgtagagtgacctaacagtatttgatgtttttgcatttttgactttgtgttcctgcataatttctgaagcctttggttcttcaaacagtaaagtcaaattagttaatttttctggttattatgtaacttcctatttggttatttgtttacaactggataaattatgtttttatttatttatttattttgagacggagtctcgctctgttgcccaggctggagtgcagtggtgtgatctcggcccactgcaacctctgcctcctgggtgcaagcgattctcctgcctcagcctccctagcagctgggattacaggtgtgcaccaccaggcccagctaatcttttttgtatttttgtagagacggggtttcaccatattggccaggctggtcttgaattcttgacctcaagtgatccacccacctccacctcccaaagtgctaggattacaggcttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattcttgaaaacctggcaggccggtgcttgggtgcaaaactattcagtaaataattattagctggggatttttttcccctatataccaggtattttgagagtgtaaattggtgaaaagaggctttttaaaaaaatgtttatttgtatgtgccttttttttttttaaagtatatgtactccatcaattgaacctatccatacattcctctttgtcttttctccaattttgaaactcagtaaacttcttcagggctgtgagaactcttctacccccagcttgtttgaattcttgtgatgtcagagcctaaacttccaagcatggaaacagtaccaacaacgatgagccaagtaacattttactcttattagcaggagacttcatattattggcaaaagaatatggaacggagagccaaaagacctgggttccagtgtcccatctgtcttttatttgcttgtgatttctgatgagccatttagcaccagaagtttgagctctttgattaatgtttgccagttggggataatgctgcctgcctgatttgcttcacaaggtgttttagataaaatacagtaaggaatgagaaagcattaggaaattctatattgttatacaaatatagagcatttttattaaccccttatattacttgaatcaaatatgattatggttggatggtttaatgtctttcttgcattttgacagcactaatgttattattgtataaagtaccataatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaacttaaacaaattttcaaacgtgctaaaaagtagaatagtacaatgaaccaccaccatctatccattgcccagatataagttatctacattttgcaacatttgcttgatccatcctttatttttcccttgctaaagtattttagtgcaaatctcagatatcttgtcattttactcctacatactgtcacgtctttaaaaattaaaattaacatattccttggtatcatccagcattcattccataatcaaatattaccaattgcctaaaaaaattagatttttgatctaaggtgtacctaattgatatacatgtcactgaactccttaaacaaatacagctttaaattactggtaaaatcttattcagagttactccacataaagtgctatcataaagcctcagcccaaattaagttcacttctgtctttaattctgtagaagtatctggaaaggttgactatacaagggtggatagactccttggaacagctgttatgtaccatcaaaaatagaacaaattagttttggctttactcactggttgggcaatcactaattcttcattttgcaatttgtgaagtggggtggggcttatgtgtaagaattttcctttcagggaaatgctgtagatagttaggcaaaggaaaattattcttcatttctctagataaagcgttcatatgactctttgacattcacaccccaccacaacaactaagtttatgttactggctctagttttatttcaaaacaaatgccggtttggtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttatttgtcattggttctgagaaaagaatgtaagatgtatatttatgtaatatcctacacctgattacttttgcttttgaattattgaaatcttcaaatgtagatggctgtgcccttgagggcctaggttatagttcagtatgttcattatcttccccaacttaagggttgagttctgttatagctaattgtagatcaattagcttaaggctcctccctttctgcactcctttcagcaattttcttgacataattgtttcacagagttttatatggttacgcattatctaggctgcattttttttttttttagatggagtctcactctgtcacccaggctggagtgcagtggcctgatctctgcttactgcaacctccgcctcccgggttcaagcgattcttctgcctcagcctcccgagtacctgggattacaagcatgcaccaccacgcccagctaatttttgtatttttagtagagatggggtttcccaatgtttcccaggctagtctcaaactcctgacctcaagtgatccgccctcctgggcctcccaaagtgctgggattacaggcatgagctaccgcgcctggctgcattgttttttgaagtttgtaccatgcttatttccactttcattgctcacgatacagggcagaacatatagaaagttaagatgggttaaaacaaatttggcagaagcatttcctctgataatatgctctgcaatctagtacctcacattacaaaatcaacgtttttcagaagagtcagtgtgtacataaaatatttgtgagtgaaaataaacttcttagggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccacttcatgtttttcaagatgcctacattgtattttatggaatctaaatgtatttaatatgctatacagagttgaaataagctaaataggatatttgatcctattaagtgttttttaggagtttgtttctggttatttaaaaaggttgggctgggtgcagtggctgatgcctataatcctagcactttgggaggccaaggcaggaggattgcttgagcccaggaggttgaggctgcagtgagctgtgatcgtaccactgcattccagcctgggtgacagagtgagaccctgactctaaaagaaaagaaaaattttaaaaaaagatcctgtagagataagccgactactttttaaaaatgtgactctggacaagtcttttatttttcttctctctgggtgtcagtgtattctgtaaaataagggaatcgaaatagatgatctacaaagttccatttagctctggcatactgggagtcaaagtttattgaaagctgtaatacatctaccctaacataaatacaagacctctggattccagttagacaaaaagttggaattaggctgaatgctaaagagtgaatatcccagttaactttattgtcctgtttctggagtctaggttagcctagtctagtgaaggccacatcaacgtttctttttaactatgaattgtacggaaggtaatggtctgagccctagggaatgctggcttcctctgcgtcatcctgattcttgggaggatgctttggttcagtgaccaagtacagtatgcaagccttcccagagatgattctcaatagtacacaatatcataggtaccagtttttgttctaagtgctttgcgtgtatttgttaagaactgtgcaaggtctgggattttcccttacttacctacctgttaactgtttaatggatgattgcagaagacccaaaggacaaaagacagtttattattcattgcaaaagcagtagccagaatgtcagcatgacatgctggttcactatgaccataagtcccatcgtgggtagaccagcatgatggccacaaacggagtcagtgacattgcaggagaggaactctgagcttgggggtttgctacttttatagcattaagaagtcagcttgatctttggggtggggagatatcacctcatcctcaaggttgtttgctacaaacacagccatgggaaatggccccagtaaaatgctgtcagtgccttttagtcttggcatagccagcaagaatgggcaggggatgctcagggattcatggcagattgcctccttcatcagttttaactaatttcatcctcacagcaatcattttgtaggtgaagaaaacgtctccaagcagatgagtaactggcccgaggacatgcaaaggtgaatttagaattgaagaccaatgtggggccagatgtggtggctcacacctgtaatcccagcactttgggcggccgaggcaggtggatcaccagaggtcaggagttcaagaccagcctggccaacatggtggaaccctgtctctactgaaaatacaaaaattagccaggcatggtggcatgtacctgtaatcccagctacctgggaggccgaggcaggagaattgcttgatcccgggaggcagaggttgcagtgagccgagatccgccactgcacttcagcctgggcaacagagcgagactctgtctcaaaaaaataaaatatttttaaaaataaaatagaattcaagaccaatgtgactgtaaaatgtatgttttacaccacgattttctatactgcctgagaacctcaaggtagctctaaattgaagacctagtggttctctagactggtgatggtgggacctagcctagatttgcactctgcttatgtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaattttttttttttttcagtagagacagcattttgctgtgttgcccaggctggtctggaactcctggcctcaagtgatcctcctgcctcaactcagcctctcacttggattataggaatgagccaccacacctggcttgattaccaatgttaatgagctaatatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagagagggaactaacgtttagtgagcacctacagtatttcaggtgttgttctaggagctttacatcaccatcttaattttttattataaacacgtaggcatagttatttcccacatttaacaaatatgggaaacgagtctcagagaggttaattgattctgattccaaaatacatgatattttatgatagcattctgtcttcttcttacaagtaacaggctatatttaaaatctagaaatgagctgtaattttctattttttacataaatatgttttatttttctcctatcgcagatcctattaggagtctaataaatgtattttaacacatttcctttttgttggattacattagttgagaaataatagagcttgagaaattggctgggaattgtccacaaacatctaatttgtagctgtatctggttagttttattactgatgatttgggcaagctcctcagttggtaatattctacctctgaaattcttcatgttcaatagttaatctaatttaataaatgttttggagaagctcacctcagtgctgcggtaagcattatcagggttaaagtaaagaactcctacccactagaaacatagagttggagaatctgatgtatacaaacctgtggtgctgggtggaatgtgataagtgctactgtagaaggaaaaagtgctatgggagcacaaatcgtgttaattccaaatgaagtattagggatgacttcatggaaagataggcaatagaagagagtcttaaagtgcagagattttttttaaaacagttattgtgatagaatggagaaagggcattgtctgtagtgagaaaaatatgcatatctcagtcagcacaggctgctatagcaaattcccatagactaggtggcatatgaacaacagaaatttattacacacagttgtggagactggaagtccaagatcagggtaccagcttgatagagttctggtaagggccctcttccgagttgcaaactgctgacttcttgtggtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatgaaaggcccttgggcaggggctcccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagcttgcaaaaaatatagatacaggagtcccaatggacctattgaaacagaatcctttgagtgcaggccctgggaatctgcattaataagctgcctgcatgattttgtactctaaagttggagaaccactaaacttgtgcacagtttgcaaaatggcagccctgcaagtcatacctggcccatagatttgtttggtttggctttcagtattagcaatgtggtttttaaaatttgatttgtttgctaactcttaagaattgggagtttgtacacataaatctaaattcctggcttctcttgaaacatcagagtaatttttacagtactaggctcatgttctcacatggctggcagcaatccactgtgtctgaataagatctgtcttatttgaataggccatgtgctcttgaattggccacagaccaccctcctgcatttcacctggggtccagtgttaattgacatttatttttctatagctggcctgcatcactcaattatatcccctgcttagaatccatatacatttgagtttttgactctggatctagaggttaagaactacacagaaactatgggaaagaagtgagactggaagctgggagaccagagagattataatagtggagataagaaatgaaccatggaactacggcagtggtactagggatggagaagaggaggaagattaggatttagaagctactaattgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggcatatgcctgtaatcccagctactctggaggttgaggcaggagaatcacttgaacctgggaggtggaggttgcagtgagccaagatcacgccattgcactccagcctgggagacagagtgagactctgtctcaaaaaaataaataagtaaaagaatacatatgtactcgtctcaaaagaaaaaaaaatgcttggcacattgctgtagggtatcaccaagacacaatgatttaatgacaaccacttctttcttgcaagtggtaattttggtttctttctccctttatctcttctgcattttaaattttgctctgtgagtattctttagttctgcggatgctaggagcatgctgtattctaaaaagtgtttgcaaggcatttttctttttttatatctccaagaaaatgtttctttgggaacatgttatgaatggaggttaggttcccagggtagctcatctttttcaaatcccacttaatctacattgcagatgagctgttctattaatagcatgtgtctgagctctgggagcagacatgtgccatgtggtatagaaacattgaagaaagtctcttcctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatattttatttttatttcagtagttttgggggaacggggggtttttggttacatggataagttctttagtggtgatttctgagattttggtgcacttgtcacctgagcagtttacactgtacccaatgtgtagtcttttatccctcaccctccctcctgaaaattcattgcatcattctcatacctttgcatcctcatagcttagcacccacttatgagtgagaataaatgatgtttggttttacattgctgagttacttcacttagaataattgtctccaacactccactcaggttgctgcaaatgccattatttcattcctttttatggctgagtagtattccatgttgtatacataacacatttgctttatccacttgctggctgatgggcatttaggctggtttcatatttttgcagttgctaattgttctgctataaacatgcatgtgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctgaaaatgaagagaccttttaacctggtgggtcaagtttgacttaagttcttgaacaaattcactgtaagtactctagaggcagtgtttatgagggaatttagatgccaggataatttttttaaatagaaggaataaattgccccttgtttcccaattaagacacctaagaagcttgatctgtaatcatgtcttctgtggttactctctgaagtcttatgttgaaataagtggctgtctctcttctgtccctttatgtaccatcactggtatagccagtcctgcctatagaaaggaaaaatcaagttttttacacctcgtgttagaatgggtattttctacagaaactgtttcaaaggagaatggagttggaatactacttactaccagtgtgactctgaaggtgtattatagatttttataggattttaataaggttttttaaagctgatttgcgaattcaaccatcattgagaactttgtttctgtaagaaaatgtagtcgcagaactaactccatatgtttcatcagggctacgaagggcccatgtatgtagaaaacttcagtagtattgattatggctactaaataggtaattttgttgaaaataagtttaacattattagcaaatagaatggtaattgaagagaagttaatttaggaattttgtaaaaaacttggctatgattatggtactgacacagtaatgtggggccagaacttatggtaaccccataagagtgattctataatttttttttttttttttttttttttgagactgagtctcattctgttgcccgggctggagtgcagtggtgcgatctcggctcactgcaaccactgcctcctgggtttaagtgattctcctgcctcggcctcccaagtagcttggattacaggcgcccaccaccacgcatggctaatttttttgtatttttagcagagacggggtttcactatgttggtcaggctggtcttgaactcctgacctcaagtgatccgcccgcctccgccttccaaagtgtcgggattacaggcgtgagccaccacgcttggctaattctataaatttttaagcgtatctttatttgtttttcagtgatctactgactgtaaatcattctgtcagcttcatagtaacatttaatttcaacctacccagtccctaattggccaaactgttataaaaccaaattacgcagcagtgaggaaaatagaaacttgaatgaatgctattaaaataagtttagaccatctcaaatttatcctcataattcagactttctctgttttcaaagaagacgtctcatacacactgagtgttattggcagatttgacatggctggagtcttatgtgcagaaatataatatgtatctgtcagtggttttcaggagcccctatgaaagggcttgattttgctggtttgaagcctttgttggcatcagcaaagtcaaagagttgtaggcaaggttaacagccacttcatatttaatgggtttatgcaaaccgtgatctatatattgattatataaaatacatcactgttgtcttaacatccagatgaaaaggaaaaaaatgttttctacatcaaaatctttagacttaaaaatctctgtgattcataatattaattaaaagagaaaataaaaatctgaataatttgctttgacctgtgtatgtataagggtcattataagggttagtgcttgggttgcttgtgagttttcaggcaaagggacatacagctcatcttttttatattgcaactgatcagtgattaatacttaagaggcttcaggggctaagtatagttgctgatttatttgcagctcttactccacttcaattatttaaatacagcgaagagtccgtcgtgagaaacacaacagagtaggagaaatttgagatctatcagcataaacagatacaagtgttgctttgccccaaatcataaaaagtaaaaaaattaaaactacctgttaattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatcctgcttagtgtgttttgtaagatatgatacacctagcatattcctttctaaaacatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagcactacttggctaaatcattgatctaagagtatctgttatgtacaaagtactgtgttggttttgaaatttttgtatttgtctaaatctagctttttcatttctattgctttttattcatagtctaagaaagaagaactttcatgtctacacaacttttttttcccatttgaaatgctttaatattgtgaaccccataaatttgagacaggtctcagtttagaaagtttattttgccaaggttgacaatgcgcttgtgacacagcctcaggaagtcctgatgacatgtgcccaaggtggtcagtgcacagcttgcttttatacatgttagggagacatgagacatcaatcaatatgtaagaagtacattagttccatccagaaatgtggagacaactcaaagtaaggcctccctactgggggcttccaggtcacaggtaggtgagagtcagatggttacattcttttgagtttctggtaagtcttttcaaaagaggcaatcagaatatgcatttgtctctgtgagcagagggatgactttgaatagaataagaggcggttcccagcttgaagaggcccaagatattttcctttcacagtataaagcaaacaaacattctttctatacctgtagaggatgctactactctaaaagctggattattcctgcaattgtttctgcttaattcaggcactaagtgacttcctccaattcattagtgtgaacattcttaaagacctaagtggcagacatatttcctgaaccatttacccttagtcctgaagctgatcaggtttgtcacacacagactgctatagtcacccctcctggcagttcaagattgagctttatggcaagacaattcatttaagattgagcataacttgttatgacagatttatcaaaattatccagtgaagtaacatagacttctgctttgtgaagaaaactgaaaccctatactgtgatgtcatatttgttctcttatagataaatattttgttctttataaattgaaagagcatcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgtttaccactgtattcccagtgcccagtactgaacagtttcacttatgtcactcgtgtccatgtgaagagaccaccaaacaggctttgtgtgagcaacaaggctgtttatttcacctgggcgcaggcgggctgagtccgaaaagagagtcagtgaagggaggtaggggtggggccgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgactctaataaagatttttgggggggtcatttttgtttctgactttttttaactccatagtagctctgtagtttgtacacaggaatgaaatccatgtttacttgcatgtggtgtgagacagatgcacccatccacataaatgaattttgagagcttgtcccagaagaccatcattataaatgaaaaaaatttttttggtgtttctgttgttattctcaagtccttttatacctttcttttttgactaatatagaaagataattgtgtagcagaaatgatttcgttttgtttgcagatcatttaattgtaacttatacaatgatttcaatgcatgtttaatgtacagtggctaaaaattaccccttctgaaattcagcccttcatatctgcttaaagattttccttttcgatagaccatatttgttcttttttctgaacagttataacgaagagctttaaatagtattatatttatgaaagcagatttttacatgagggaaatctgagaaaatattcgtattaaatgtatgtggttatacaggatatccactctagttgaatgaaatttacaaatcaagaaatcaggagtggggtgtttttctttatgtttctctatcacacgtaattaggataattttttacataagtataatttcctatgtgccttcgggtactctatcattcttgtagatgcctgtcaggaaaaaagaaaattctttaagaataaaacaaagcacagtccttctccagtattatttttgaccaggggtccacatttggtttatcaacaactaaactttcaattcaagggcagctctagaattagaaatgtatatagcagaatggacattccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgttttatagcttgtggcctaaatcactgcctatattagataatgaataccatattttgagtattcagaagtttatggcaggagaggggagagatgaggaattaaaccgtattacattgttaatttgaccagagaagaactagagatcttgatttgtgattcattcattcaaaattatatcccacatgttactgtacattttttgtggttgtctatttacctgtagttgtccacaggagtttcaaaggtcgccttacaccaaaataaaaggttaaggatcagtgaaatctagaccctactgtgcccactgtggaacatcttgtcatcacctctcctgctaccctcatgtttatttctctcctgcacctagaagagttagtaggccttgaataaatatttgttggtagctgttgaatgaatccaaacaaaatttccctttaaaattttccttgactattccttccatctagccacaactggcattttgggtattcccctgaaacgagtcctgacacttttaccctttttcactcttcttcctgcttctgtggtgcaccctttttcctgctgctcctttcgtgctatcttctttaaaccatctttcaacaaccttttctcttttgaagtctgttattgctgaccttccttgatgatagcacctggctatgcttttgtcctttacccttgctactcattttggtgatttcaactattacgctaatagccttcaatacattttttgctcttagttccttgtttgctaaactctgacttttgcatttatatatttagctaattataggtatgactgtaccttggactgtgtcatcctttagaataattccacctctaagagctttaactctaaaattttccttagaagctaaacaatttacactacctttccaagacccttaattttatagagcatgtattgtgtagtggttaaaaacctggactttggggtcattcagaatgtttgtagtgtttctttcctttatcaaataagctctgttgtgtctttaattgctagtattttctgattacctagatacccctcagtttatcaccctggtgtccttaatcactgaaaacaatgatgacagcaacaaacacagaaacattccttgatactattaacactttttatctttttaaatctttcttctctttaaataaaaattatactcattgctttaagctgctgacaatttggttactaccttttgcagtattgaaatagttctccgagttcatcagtggcattgctgtattcagtttttctacactgagcattacagggctatcttcccttcattgattatctcattcacttctaatttcttgccaaatcccattggttttgcttttgtaataactgttacatttgtgtcctcagatgtcctccagctgttcttgccctactttagatgataaccctctctagttgtttctcatggctattaaaatagcctcccaactggtcttcctcccatcctccaggttttgcctattccaatccagtattgccctatgatttggacacagagttcttttctgaagccccaggtgggcctttatgttttcagagaatcagtttatatgtccctactccgttccctcaactatgcccctagatgcctttcacacctttgcttttctgctccaacctcagagctcttccccatctttattctctgctgatgaccttgctgcttaatttacgagtaaattgaagcattcagaagagaacttccacaggctccccccaccacatttaccttttagtatctgcattcatgtatctgtcttgctacctatcaccatagatgaaattttcatgtccgcattcttctgcttgtgtataaattttcattcctttcagctactcacagatattgcttcaataattttttcttctctctcctaccattctgagcagcatgtaaacatgcggtcccatttttcaaaagccttcttttgaccctttctctgttgctagctatcactccatttatttactctccttggaagcaaagcacctcacaatataattttattcatatgcactgcttccagttttaatcctctcactttctcttctaaactcactccaaccaggtttccatcccaccattctatcaaaactgctcttatcaatgtcaccagatatcttcatgctgccaaatcccatggtcaattctcagttctcatcttaatttttttttttttttttttgagacaggatctcactctttcacccaggctggagtgcagtggcataattatggcttactgcagcctcaatctcctgggctcaggtgatcctcccaccttaacctcccaagtaactgggaccacaggcatgcagtgcaccaccatacccagctaatcattttgtattttttggtagagaccaggtcttgctacattgtccaggctggtcttggactcctgagctcatgtgatctgcctgccttggcctcccaaagtgctgggattacaggcatgagccaccatgcccagtctctcatcttaattgacctatcagtagcattctgtgcagttgattattctctccaatttgaaacactttttatttttttgtctcctcaacattcatcttgttttcctcctacctctcaggccactccttttcagtcttctttgctcattcctctttatgtcctgaacctctaaatcaaatttacattcaacttagtcctcacatttgaactccagactcatatattaaacttcataaccaacatctttccttggatgcacaatagatctctcaaaataacacaaccaaaactgaactgctaatattcccctccagacctgctcctacaaaagtcttccctttctcagttgacggtatctccatccgtccacctaggccaaaaactttggatttgtccttcactacccttttctcacattctacagtcaaaccattagaaaatctcattagcttttccttcaaagtaaggcactttcaacagctgaccatttcttacccacctccactgataccacactagttgaagtctcagctggaccactataataatggtaggattattaggattaccacaacccctaattgatcttcctgctttcactcatgaccctctattcttagcacagaaagattattcatttaaaatatgaacatcatgtcacttggctcctcaaatctccaccatggttctcatgtcactcagtgaataaaagccgatgtacttgcagtagcttataagatcctatatgttttgacacccaccacaccttacctttttgatatcttcctctactattctctttccgctagctcacagcttcagttgcactcatgccttttattttattgtagctctaaggaacaatgattcctgttagtttttctttcttttttttttttttgagatggagtctcactctgtcatccaggctggagtgcagtggcgtgatcttggctcactgcaacctctgcctcccaggttcaaacgattctcgtgcctcagcttcccaagtagctgggattacaggtgcatgccaccatgcctgacttatttttgtatttttagtagagacggggtttcaccgtggccaagctggtctcgaactcctgacctctggtgatccgcctgccttggcctcccaaagcgttgggattacaggcatgagccactgtgcccagccgattcctgttagtttttaatttttaaatttatgtacaacatttacagtgtttttaaacttcgtacatttctattttgtggtttgaatatcataatgtttcatcagaaaattactatttcctctttatgattttttttaaaaaaggatttgcttgttggattcataaatgtgatttaaagaactgtacaactttgtgccacattttctcaaatgggaattttttcttccatgggaattttgaaataggatattaagaaaatatgtttttcaggtactatcatattgtgttataattttatttgatggatctcttttatgttatgtgacccacataatcattatagacttgtatatgcagatattaaaatcctgtttatatctagtagtggaattgctggatcatatggtagttctgtttttaatttttaaaggaaccttcatactatttatcatagtagctgtactaatttacatttttaccaacagtgtatacaagtccccttttctccacatcctggtcaacagttgttatcttttgtcttcagtaatagccattctaaaagatgtgaagtcatatctcattggtgtcttaatttgcattatgttaagtgaaataggctaggcatagaaagacaaatagcacatgatctcattcctatgtgaaatctaaaaatgttgatttcatagaagtcgagagtagaatggtggttaccaggggctagggtaattgggcagtggggagaggggtaggttgaggagatagtggtcaaaggatacaaaatttcagttagatagaggaataacttcaagagatctattatacaacatggtgactattgtatttttgaaaaatgctaagagtagatgtaaagtgttctcaccacaaaaatcacaaccatgtgaggtaatgcacatattaattagctagatttagtcatcccacagtgagtatatacttcaaaacattgtgctgtacatgctaaatgcatacaattttatctgtcaattaaaaaaacttatttataaatggacatatattatttttaaataacagtataatataataggatatcagagaaatatggtttgattaaaagtaacaaccaaaagttaaactgaaaactttaaagattatctctctactttgagagaagtctacttataccctgaatattgcgtattttctatattagtttgacggtaataaccttacagtgaacaaattattttatgaataactatagttttcatctactgtatacttatgcctaaggcatgaaactaaaacatttaagtgtattatttcaattgatccttatgacagtgccacaaagtaagtaagattgttataccccattttcagatgaggaaagtgaagcttagagagaggcaagaaaattggttcattaacttgactaagctagtaagtagctgagccgaaacttaaatttaggtacataaaaatctaaaacattgactttttgtaacatctgcctttaataatgcttcatttaaactaaatataaaattagtacattttccttgcacacatagtgaggagaagtagaaggcaaatcagaggtacattagagtggtaggtaaagccagcctgggatggattatttcctactgataatggaacattgtctgtaattgctttttatggagcatcaattgagaagaatgagtccaaaaatctagcaatggaaaactgttaaaaatgtcattatcacagttgattgggagaaagcacttaagtcattctgtttctaaaacacggaagtagacttccagatatgaaatttatctttttttatttcactccttgtgggtgtctttccttgtacaaataacgtaaaaggtgttcttgtcgtatttgatggctcttatgacaatcttccttcttctgggtcttttgatggtagctttattgtgctgtttctcttgattggcttttctgactttagagaactacaaaggtttagaccatttggtttcaatactatatatgtattttaggataacatactttgaggtgtaaaacttttttttttttttttgagatggagttttgctcttgttgcccaggctggagtgcaatggcgcgatcttggttcattgcaacctccacctcctgggttgaagcgattctcctgtctcagcctcccgagtaggtgggattacaggcacgcgccaccatgcctggctaattttggatttttattagagacgggttttctccatgttggtaaggctgatcttgaactcctgacctcaggtgatctgccagcctcagcctcccaaagtgctgggattacaggcatgagccaccgtgcccagccaaaacgttttaaataattgcagcacatagcatgagattatgcacagtaataatatatgagacacttgacaagaaataaattaccttacaatttactatttagaatttctgggtaatgatgtattggtgaaacttttggttaaaaacttaacaaaagataatattcaaatataatcctttcttactctgaaaattgaaactcttgttatacctgaggatcacatctatcaacagcagttctcattggataggcttgtagatgtagataattgagctaaatctaaaattactgcaggatatgttttttctaaaagaaggtagctgtttttacttaattactaatagatcatttcacaaatcacttgattcttcatagctaagaaaaattgtgaaatgagtccagttaactgaaagatctgagtagtctggttttactagtgtattagtagactactaatgtctcattgactctggcatctattctgtgcattggtgcatcacttttcatattgtgcttattcaatgatgcaattttaaagggactttctaagtaatggtatcaatggctattgctggcaagtttaaagttccaaatttgaaataaatatttatttatttttttgtttagagacaggaccttgctctgttgtccaggttgtatcatgggtcacagcagcctcaaactcctcggctcaagccctcctcccacttgagcctcccaagtatctgggactacaggcatgtgccaaataaacgtgatttttttgtttattttttgtggagatgaggttttgccatgttgcccaagctggtctccaactcctaggctcaagacatcctcctgccttggcctccaaagtgctgggattataggtatgagccacggcacctggctttgaaatttcttgatgattgtttattttatagaatataagctctttattaagagagtgtctttcatagtttgtaaaagtgaattttgtatttagagtatggttaccaactactaactgaaaattgagaagtggttcttttactaaagttttcaagaattaaaaccactgcttttataagattgataaaattacctgcatggggtaaatcacacttgctctttaagattcttgtctccctcccatacccagagtcatgttttcaaatcttccacaagtgggtaaaggtagtaggatgaaaacaatactccttccatgttattattattggtaactttttttttcttttgttttttttgtttgtttgttttttcgagatggagtcttgctgtgtccattaggctgtagtgcagtggtgtgatcatggctcactgtggccttgaccttctgggatcacacaatcctcccacctcagcatcctgagtagctgagactgtatgcacgtgccaccatgcctgcctaattgttttgtagagtgtgggtcttgctattttgcccaggctgatcttgaactcctgggctcaagcattcctactgacttggcctcccaaagtgctgggggttacactgtacccagcctatatttagtgacttttaaagatgactgaactaaagcggttcatattcgtaactcttctcatattgatcagaagcattttatattgcctctaattaggattggatgaaatatctcctcaattccactttaaatgtaaggaaattaataatgctgtaattgagtaactcttcaatattttaagttgtcataacctttgagcttgctgagaataactgatctggtttttgtacattgagtatactgcttagggactgttaaatgcttattagtgttttcatctagactgaattatgcaattagagttctttttggggagaggggtgttgggagaggggagattttcattttaagattaaaaaagtaaacccatagaaatttcttgggagttcatgttggaatttgatttctattagcagcacaaggaactcccaagtggaggttcaggttgcattggcaacatatagatacgtcaataaggactgtgttctgatataggtaattaaatagtttgtcttatgcaaaagatgaggctagtaatgatttatgattaacctctagccatatttcatttcaacctaatttgttaaaggtaatgtttaatatatgattatacatgcaaatttgatgttttacactcttttctattcagcaatttatattaatatactttgcatttttgtcataatttaatgataatagttatatgcaataaatactaaattattccatctgctagaactctcataagtaatcccaaaccttttaatttttgttctctcacttttctctttcattaatttagagagaatagttgtgcttgaacaccaggtgttatacattaacccaagcatccttgttctccactgactgctattataggtttctttctcacccaaccctagtcttttagaagttagttagcttggatgaatcttttcatgccctcagaataagtaattttaattaatagtttaaggtagcacaaaataaattattggtaaactaggtcttaaaatctataataagccatggaaatagttgtcagaaatgattagaatctcagaaattgtctagacagcataatatccataggttatatttacattttcaatatccttactccatatcattagacggagataatgccagaagcatttctagacaacatgttttattttcttataaaactcctatgacgagcttataaaagaggagcaaaacttacccagtaaacagatctaaaaggtaactaaatctgggtcaatttttaattttattgccgagcatgattttttaaaaacttggctctgttcttgatttgtacagagaaatgctttcaaaaatatttcttctgttttgaaggattctactagtatttatttgcatgagtgtatttaagcaactatttattcatatgtgcaatgtgccaggtaggatgctacatgttggaagtgtaaagatgaatgcaacacctcccttaccctcagagagctcagtgtttactcagggagaaaagtacataaattatttccatagcactaggatagctgtgaataggctactgtgggaacttagccctgtgtaggggctcaggatggaagcagagaacaccacctaaatacactgtgaaacccagtgttacttctgaattatccgtctttattttttggcataaatgttctcaaaatttgaacagtttagttcatcaaagtcccatgccttccatatgcccaatactgttttaaggtctgagaagagagcagtgaacaacttaaagaaaatccctgccatcaaggagcttatgttctggcaagggtgatatactggaacataaggtggagttataaaagaaaaggaaaagacaaatatctgtgtcatggtgaagtttatttgacaactctctactgaatgccagatactttgttaggtacagcagacataaagatgtcaaaggtactatccctgccacaaggtttttattttgtatatcctgctgactaagaatggttttatatttttaaattgttacccaaaaaaagactgtttcagggcacatgaaagttatatgaatttcagtgtccacaaataaagttttgctgaatgtatccacgcccatttgtttatgtattgtctatagctcctttgtgctacagtagagttgagtagttgagacaaagattatatagtttgcaaaacctaaaatatttactgtctggcaatttacagaaaaagtttgccaacctctggactagtccaagagtctctaaaccttttatttcctaccccatcagaaaaaaaaaaaaaaaaaatatatatatatatatatatatgtttgagtaagtagccctaatatattttaaacattatatacatgcatgtatgtactaatattaatatgtacattacaaaatatacacagtaaaaatgagaaaaacatgaacaagattttaaaatgatttaaaattagtttatttcttaatcatacagaagtctttgctgtcatgattaataactttttagtgagaacagtgtcactatgtcatttttttatgtcttgcttaaaaataggcggtaattagaaagtttagctccaagttcattttattttgatatttggtttaatttctctcataattgaaacataaatctgacaaagatttgtaggtccaaatcgaacaaatgcaccattagcaacttactaaattgtagtattaacttttatcagaccaatccatgaatcaagcaaagatttcctgctgaaccatgactagtaaattcctgtcttacttgatgacagccagttattcttgcaactaatctggggtgttgcatttttatatttctaaataaatgggtttaaattggactttaataaatgggtcttcaacaagtgccattgggaagatgggctctttccattttttcttctacattattaatgtgtagaccctcatcctcatgtttgtgtactcatgcctgttccagacagtacatctaacaccaggaagaaagaggaagtaattcaagcaagggtgaaggggactgacttggaagttgagtctgttgggactgacttggaagctgggtctgtctgtgtggcttttccagtaaagtaggtttgaaaaggagttactttcttactaattgttaaaacgtcaaggaatttcttcactttttgtaaatgaaaaatgcctaactcatgctatatttcaagttttttttttttttttttttttttgagatggaaactcactctgtcacccaggctggagtgcagctgcgcgatctctgctcactgcaccctttgcctcctgggttcaagcgattctcttgcctcagcctcctacgcctggctaatgtttgtatttttagtagagatggggttttgccatgtcggccaggctggtctcgaactcctgacctcaggtgatccgcccgccttggcctcccaaagtgctgggattacaggcatgacactgtgcctggctaatttcgacagttttaaaatactttatcttgaaataaccagaaatatctctggttttcatgttaacttcctatttcatttcaaaatattgtaaatattttattgtatttgaaatatcttgcttttatttaaagaagaacaatcttcttgactctgtagtattctgtatacttcagtttcaacttcttgcaatggccttgaattttacgtgtaggtttacctgactcaggaatccttccctcatagtttttccacaaaacctctttttattaaataaatcatttattttggttatgtgttttctctgttaaattgttctaacggtgacacaaagaaaagtagtttatatatgtcattatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctggtattacaggcgtgagccaccgcgcccggccgacttcagtgttttttaaaatcacaaaatactacattttttctcatgtattatagatatatcaaatgttaaacatgctaaaagcttgcttttgttttgaataccataagaaatcagtatgtttagaaatagtttcatattcaattacgctgtttagagttaatattgaattatgaatattgctctatttagctttattattgtattatggatctggagttaatgatttggaagtgttagctgcctaattagtagaatgtatcttatttctatagaataaaatgagtcattatggtcttttcacatgaatgatactcatttccaatcaacctatgcagcaaatttataagtataaaaaactgttgctgattctaaagcaagttaatatatttaaagaaaaggtcttaaatatcacattggttcaacaaatatttattaaatgtttactgcattccaggaattatgctctttgctaggagtacaaagataagtaagttcctattttcagcttcgagtttagaagagatagatttatcacataatttcaatgtaagtgacacataaggaattaatatggaagactaggataagggtaattattttcaaatcaggtgctttaggagaagtcttcctgaaaaattagtggttgagcacagtcttgaagtataatagccagatgtgaatttggagggggcaaggatgggcattaacagatggagaggatggtaaagatgaccacatttcaggcagggagaacagcgcatcatgagcaaaataatgagtgtgtaacaacacagtttatgtagcaaaactacaaacaacctaacattattaaaacataaggggtaagatgaaaagcggttaaaaggctgaggttgggaggtgataacgctaatagctagcattctttgaaagctagttaatatacaccaggcttgtcatgcatgatcacacccagtcttgacaacattcctctgaggtgtataatcttacattgctcttattgtcctgcctgcctccctacaaaataattctgtgatggcgtgatatcagcagtgtgtgccattaaaaactgaatgggtacacggtaatgtagaaatgtcactggaagcagagaaactctctacctagagactgccaaaggtgacgccaccacactcttaggccaggctgtgaagtatacaaatacagacacttaatcttgtcactgttccagagttgattctacttggaggttgcggattgatgataaccacatttacaggagactgaaatttaaccagaatttttttaggcaatagagacatagcccagcatatgtgagcagaacatagggattttgatgaaaacaaaaacaatatgagtcagcagaatgatgtacttggccagtaagataataaaatcaagagggtgaattaacagaggtgtaagtatttcaaggtgagggaggtggacattctttcctaccttgcatttgttaaaccacagagtatttgagagagagagagatgtggacaccaacccatgttacatgaagataagttgagtactttagcctgaaagaaggaatgtggtcttcaaataacatttatgtggctcttgaattaatttccttctgtccaatctgagttttcttcttagttcgactcttatctctagtcacttaaattacttcagcccaaattattgaacataagaaaaatccactctggcaggtttaaatagaatataattttagaggatattacgtagtcttgaattaacagagttgcagaaacaggctctagataacattataggactaacttccagaaccacacaactgaaatacagttccaattaaggagctcttatcccagaactatttgatcaaaatgtcttaatgaaaaagacacagttaatgccatcagttctgtaacaacatcacctctgttgccacctacatcagcaaaatgaatggcctattcgtggcctgcttcctcacatagttcacttctaaatctacacctcctatgcatgcattttattggtggagactaagccacatgcctgcactctagttaaaagggagactgacaaatgtagtttttatggattctacctttgtcaggtgggactgacaatgtgaggatgtattaaattgtagagggtatgttcaagtgatgttgagcagcaaaaaatgacacatgaccgctagagtttcctgaccggtctccttccttccagtcagatttttttcatcctttgagacccacaacctggtgaagacttctctgacctttccatctgccctgtgtttccaaagaatctgatacatgcctcagttagaattatttgttactactggaccataaattatttattcaacaaacatatatagcatttactaagtatcaggcattgttctaagtgctttataaataatatgtaatttgagtataaaaacagtctaccagattagacagcctagcatagtttctggtgtgtagtatgtgttcagtaaataagtgattcagaattttaaaagagaagaaaaaaggtcatgccacccaccttaacacacattattttgttgtacatatttcatgtccaatcattgaaggaaaaatttggcaaaaattaaactaccctaagatgagtggggctgtctgaggacgtagggagtacactgtcagttgaaatagatacatatgctgggtgtggtggctcacgcttgtaatcccagcactttgggaggccgaggcgggtggatcacttgaggccaggagtttgagaccaccccagccaacctggcaaagctctgtctctaaaaatacaaaaaaattagctgggtgtggtggtgcgtgcctgtaatcccagctacttgggaggctgaggcaggagaatcgcttgaacttgggaagcggaggttgcagtgagccaagatcaggccactgcactccagcctgggcaacagagcaagtctccacctcaaaaaaaaaaaaaaaaaaaaaaaaaaaaaggaaatagatacagaacatagatgagcatctgtggaccacattatgagtgctatccaacctagtttctgtgattctactgtgattcaacaatgccagagcctatgagagagagatgaaaaagatgtcttctgccttctagtaagtcattaacaagtaaaatatccaaatgagaaataacattagatagaaaagtggggatagggacagtgatccagataattaggaagaaaggtcatgtatatatacacaaaatttataggtattgactatgaatgaatcatcataggagttgctgcagtggttgcaaatatagatttttgctgtcaacaaagttattattcaatagatagatgcaatttgtctacttttgaggattgtcttccacattctcacatatgcatctttaaaataactttgatgccaggcgtggtggctcacgcctgtaatcccagcactttgggaggtcgaggtgggtggatcatgagatcaggagatcgagatcatcctggctaatgcagtgaaaccctgtctctactaaaaatacaaaaaattagccgggcatggtggcgggcgcctgtagtcccagctactcgggaggctgagggaggagaatcacttgaacttgggaggtggagcttgcagtgagccgagatcgcgccactgcactccagcctgggcgacagagggaaactccatctcaaaaagtaaaataaaataaaataacattgatactgttcttcgccaattagtttatttactttatcaaaaaaaaaaatagaatgctcagaatttctgtaagagtaaagggataaaaatactgatttgttttcttaaaaaatttagatatgattcacataccataaaattcacccttttacaatgtgctcttttttttgctttttctttctttcttccttttttttttttggagacagggtcttgctcagatttccaggctggagtgcagtgacaggaacacagctcactgcaacctctacctcctggtctcaagcgaccctcctgcctcagtctcccaagtagctgggactgctggtgcacaccaccatgtccaggtaattttttaaaagtttttatagaagcgaggtcttgctatgttgcccaggctggtctcaaactcctgggcccaagtgatcctccttcttgggcctcccaaagtgctaggactttggcgtgagccactgtgcgtggccaaattcataattttttttttgtatattcaaagagtgtgaaactagcacaacaactttgagaacagttgtatcaccccataaagaaacaccatacccataatcagtcagaatccaaactccctcctcttctcccctggccctggcaacctctaatttattttttgtccctataaatttgcctatttgggacatttaatatgaatagaatcatagaatatatggtcttttataatgcttctttcacttagcataatgtgatttcaagattcatccaggttatagcatgtatcagtacttcattcctttttagagctgaataatatttcattgtatgatatgccacattttgtttatccattcgtcaattgatggatgtttggattgtttctactccttggctattatcaataatgctgctatgaacattcgtgtgcaagtttttgtatggacatatgttttcattttgcttaggtatgtaagctgggtcatatggtagataaatctgtttaacttttggaggaactgccagactgttttccaaagtggttgtatcatttctctttcccaccagcaatgtgtgagggttccaattttttcaattcgttgccaacatttattattttcctctttttttctagttatcctagtagaagtgaagtagtatctcactgtggttttgatttgcatttccccacagattaatgatgttgaatatcttttcctgtgcttattggccatttatatatcttttttttttttttttttttttttgagatggagtcttgctctgtcacccaggctggagtgcagtggtgtgatctcagctcactgcaagctctgcctcctgggtttgcgccattctcctgcctcagcttcctgagaagctgggactacaggcacccgccaccacgcctggctaattttttgtatttttagtagagatggggtttcaccgtgttagccaggatggtctcgatctcctgacctcgtgatccacccgccttggcctcccaaagtgctgggattacaggtgtgagccaccgtgcctggcctgtatatcttctttagaaaaatgcctattcaagtgttttgctcatttgttactggactcttgtctttttattattgagttgtaaaagttctttgtatatctgggtacacatctatatcagacatatgatttgtaaccattttcacctattctgtagattgacttttcatttggtgttgcattttgaggcacagccatttccaacttggttttgtgaccctgtcaagggtgtcttcatatgtcacaaggattaccatgaatttcaaaatgaagaaaaacaatttgtctaatcaaagtgttataagtgtatatatcacaaaataaaggtagatttccaactgaattaaagtttattgaacctcaaaacaatgtgttcttgtaactgaatacttttccttctaatgagtgacatttattaccgcaataccgctgtttctgcttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctgaacatgtgcatgtttagatgtaaaatgcttctttgtcttcacattatgtagaaaattctgatcttataatagaaatgctaggattacctagaaaactagaataataagtaatctatcttttttataattttcaagtataatataaaacagtatcgtacaccttaaatttataacaataaaaaatatttgttttcaacctaaagtttacttctgaacttaatgcatgactttaaatgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcagggaataattagttatgatggctggtgtttggctagggaggagagactgtggagaagctctcagattctggaagtaatattaaatgcaaaggcctgaagagaaccaaaccatgtgtgtggaggcagagaagaaggaagtgagagatgaggttgactttgttgaaacaaagaatgtatattggaaagagtaaaaaatcaagttgaaggatggtcttgaagtccaggcggcaaattataaattagtttgagcaaggaggtaacatgatggaagcagtgtttaagaaaaataaattcgataggtggataggctggattaggctaatggttctcaaactggaaagtacatgaaaatgcaaattttgtcctgctccaggaagattgtgattcaggtggcctgggatatggccaagaaatttgcatttttatctagcacctccagagattctgctaaggtagtctgagaagtatacttcacactttaagaagtactggattctgatagacttattcgggaagctacctaggagatttttgagtgattcagtgaggacttgtattaaagtcctcactttgaggctaggtggggttaaataacgagtttggggagataagagatttttagcttattttaataagggctggaagcagcctgtatttctagtcttggtaccaactctctcccctaattacccacactgttacttccttagttcagactgtcatcatttaacacccctgtgattgctgtagcctaccaagcagtctccttgtcttcagtctctcacccacccatgcatattctacactgttaccagttatcttgctccagcagtaccctcttatctgtggtttcattttctgtttcagttacctgaggtgcagcacaataatacattttgagagagagagaccatattcacatgttttttttttttttttttttttgagaaagggtctcactctgttgcccaggctggagtgcagtggcatgatcttggctcactgcatccttgatctcccgggctcaagccatcctcccaccttagcctccagaatagctgggactacaggtgtgcaccaccatgcccagctaatttttgtatttttttgtagagatggggttttgccatgttgcccaggctggtctcaaagtcctgagctcaagcgatccgcctgccctggcctcttaaagtgctgagattacaggcgtgagccaccacgtccggtccacataattctattatagtatattgttataatttttctattttattagctattgttaatttcttactgtgcctaatttataaattaagtgttataggtttatatgcataggaaaaagcatactatatttagagtttcaaaactatccacagttttaggcatccactgggtgtcttggggcgtacctcctgtggataaagagagactactatatttccctcctcaaaacattcaaatggctccctgttgtcctttgtgatctcatccctgcctgcttctctagtttcatctccagcttcgttcttactggtacctgtcttctatctgcataggaacacttggcaattccttcatgccttattctttaatacctttaaatcaagcatgttctatttttttgagctggaatgccgttttcttctttagtgtgtccgccaagctcctaaatatccatcaagattaagcttcctgtcagtcttagaagaagctgtcctaggtaactccttccttcccatagcaccatgtttatagctctattgttatatttaacatattttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtatagatactgtctgtgatgggaaatgataaaatatctttctggtagatctctagaaatagcaaacagaatttggagtagggaagagataaaactgaattacttttttcaatggcttctcgttctaaataactgttgcagaattttgtgaagcaaaataaattgtttttattatttagtaacaatgcatgaaacagatttagaaaacagctaaaatgattgattttatttcactacaagccaggaataatttatccacaggtagaaaaataagcattcttctgtgacaaaaagtaagaattgatatgattacatatgatagttggaaaatagcaaacattgtaatgaccagaccttataattttaaataagaggtaatttaataagttggcagcagcaacggctttttgggaaagcatttgtctcgtcatcagaagagtctgagtttgaatcctgattcactactcattcattccctgtgagcttgtaaacctctctagactcagtttcattcctttcttgaacacaaagttactgggtacttattagtgccaggcattattccaggtgctggaatgatgaaccatacagataatgtcttcatggaacttacattcaagatggggaaacagacaatatgacacatataaaatataatgacaggtaagcgctattagagaaagcagagagtgatcagggtgtggtattttagataggcgagctctttgggcaaatgacatttgaaaggagacctgaatgaaaatgggaagagccatgcaaatatctagggaagagagaacatcaagtgcgaaggccttgaggcaggagtgtgcttggagtatctgaaggaatagcagaggtcactgtgcatggagtggggtgaacaagggaaagtatgggggtgtttaatcccaagagttagggtgactaaaaacatatgttaagcatagttagtgggttgttaatttggaaaggtaagttcaggtcattttaggagagatattttgaagaattgtcactttaatagccagccaggagccctggaagggtttgagccgtggaacgacaaaatccaaggtgtatttggggaagagaaaggtagcagtggaaattggagaggttagacataagggcaaggagatcaagttgggggttgttgctgtagtttaagtaataagggtgctgaactggagtgtggttagtaggaactaaatggaggatatagatgagagacagagactgtggaagtaaaatatcccagcctcagcaaatgattttaaaagggcagaagagatgtatgaatcaataatgactgaaatttcaagcatgggtgaccaaaatgacttgagcattcatagagtagtcagggacgagaccgagtttggagtaaaagaagattgagttcagttagatatgttaatcagggagaaattactagaatcacaatagcaggagtaaaggtatcaccatgcaagaacatttatttagctcttacagcattagcagtataattttataatttggttctctgtttcaaactactgcttttaccattttaaatgtactctctgtatattgctgctgagactatgttgctgatcattctaataacatttacctgcttaaaagctgaagcctgaatatctttactaggtattgaaggccaagtatacttgtagatgattcagtggaccaagacagagaagagtgaatcattttggtggcttgtagtatcatttaccagataaacaatctgacataaaattaagaggtcatatttgtaccttttgcaatgttcctaataatctcagtcaaaaaaacaagcccataatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttggtgatcagatgaaaataagacctgaaactatttaatgatggtatattataagtgatcttttaaaaatagcacaaacactattaaagtaccaatttcagtcttttctaatttcacattcattatatgcaacgagtagctactttcccatttcctaatgttttaacactgcaagctaacttgtacattatacttattttggataggggtatctgtatatgttttgaaaggttttgttatttgaatttcccttcatttttggaacactatcgtatcagttccttcccttcccgtgcattgtcataaattgcattatttcatcatgccagattaaattcattgttcaatgaatgctgaaatatagattatgaaatattaacaagtcatcttaccttgggcatttggaaatgtctaaaagacagcatgaatgttagtattatgtttagacatgtattttgaaaattgattatattaatatttatgaataggggtcattatgttttataatctatcctgatattagaaatgaaaagatgtatatttcatgtatgattttgcatcacaaattcattagctgtgcattttgattgtgatcatgttggatatttctattgaggatatttttctgtgtgtataatcaggtaaaagaatcaatttaaaatctgatgcttgatataagacatttaagactagtatagccattattttttgtactggattggtttattttactaacaatggaaaaaattttgatcatctatgtagaatgaggtaattatatgatgtctttttttgtgtgtttttgttgttaagtaatatagtctctacaatatatatcctttaaaagctctgtataaaatttgctgttgccattataaaacttaaagtggcataacagagggattttttttatgaggcaatgcttcctctatccagatagccttgtcggcaggggaaaaagaggaaacaatcagattacaatcaatgtttagaagttaccttaggctagatgtagttggctcatgcctgtaatcccagcactttaggagggtgagatgggaggatcacttgagcccaggagttcaagatcagcctgggcaacatggcaagaccctgtctctacaaaaaaataaaacaattagctgggtgtggtggcacactcctgtagtccaatctcctagggaggttgaggtaggagaatctcttgagcctggaagtcaaggctgcagtgagccgagatggcgccactgccctcaagcctgggtgacacagttgagaccctgtctcaaaaaaaaaaagttagcttagctactgtatataaaattttgggcccttttctcatatatttgattccatttttcattttagttaatcaagtttcttctgtctgtttatctgttcggaaaggactgtttggttgaacaaacattagttcctttgaataagtagaataagataatcttaaaaagaaaaaggccgccttagatttatgaagtgtttcagagtgtttaaagcccttcatgtatttcctcacttaagctacgtgttatatgtatttctgtaggttcgtgcatcagtttttcagaagacattgcctccatctccaaattcttggaggctagttagagtctggccttatcccatggagatttttttggctgaaagctatatggacagtcttttgagtagtttgtactgaccaaggtatttcctgtcagtggtccactgatattcataacatttaaaaatgatacatgatattcataacttgtattaatatctagtttatatgcttgtatgaaatgctttctgggtctgcattgctaaataatggtgatgtgaccagtgacatttagagtaattttttgtactgtggtcaccataattcggataccatgattattacattaattgcatgtgcttttatagttgcagccataattacctattaaaacaatatagaaaaaaatgaactttaacagcatcaaagatattaaaagcatttgggttcattttttatgctgatctgtttgtaaatttttagtaacctgtcatggttcttttctttaatgaatttgtgatctaaggagaaaataactgcttgtgcaatgtaactcttgtgcttggagaacataactgctttgtatatttctggtaaatcatttatttttattgatgattatgatgcttttttggcagagtgcttatccactcaaagagctgttctacgaagtgtgattggtgtctgtatccaagatataacatgtattctatgtgtttatatatgtctctctatatctatttatccatctttctgtctatcctcccaaagttaaatgagcttaaataggttgcctctgtgttagaaagcagagaagtattactagagaactgaggctcttccccaaaattatttcagattttcttattgtgtggagtggttttgcttggaatgagaaaagctatgtgttaccggctgaattgtttccccccccctcccgccctccccaaatttgtatgttgaaaccctaacatatcagaatgtgactgtgtttagagatagggcttttaaagtgttaagttaaaaaaaaaaagatgcctttagtgtgagccctaatccagtctgactggtgtcctggtaagaggacatttggacacacagagaggtgccagggttgtgtgcagacacagaggaaaggccatttgaagacagagagaaaagatgaccatctgtaagccaaggagggaggcctcagaagaaaccaaacttactgacactttggtcttggacttttaatgtcaagaatggggagaggggccgggtgatgtggctcatgcctgtaatcaccaacactttgggaggccgaggcaggcggatcacttgaggtcaggagtttgagaccagcctgggcagcgtggcaaaaccccatctctactaataatatcaaaattagctgggtgtggtggcacatgcctatagttccagctactcagcaggctggggcacgagaatcactggaaccaaggcagaggttgcagtgagctgagatcgcgcctctgcactccaacctgggcaacagagtaagactctgtctcaaaaaacaaacaaacaaaacacaaaacaaaacaaaaaaataaagggacaacaaatttacaaaaataaacaaaacaacaaatttctgttgtttgtgttccagtctgtggtattttattatggcagccctagcaaactaatacagtatgtaacagtcattttgttgtatttaacactgaataatagtgaacttttagagaacactaagtgccaagaaccgtgctaggcaagcttcatgtaaaacctaatttaatcctcataagaattatcacccccattttatagattaggaaagtgtggcttagaaaagtaggtacattgtttggggttacatagtaagtaagtgggagagctgggatttgaatccagtcaggctgacttcagagcttggcctcttaaccaataactaagtaagatttggtggatttcaggcagttgtggataataattgacaccacaggtgttcatcctctctaacactgttaatatttagtctttcaccatgtgctagtaggcaattcttattttctgccaactggagaatacctacagtcatacctacaacacagagagaaccttgcccatggaaaagctgctacattacagagaattaaagacctctgtgcacgtgttgctcaatgggccaaaaatgactctgccgatatggtctttgtggctttcatagcagatgttcacgaacaggtaacatcaatgcagataaaccatatactcagcaatttaaatgtgaggaaaaagatacataaatattagaaagaatcccatttttagcaatggcctataattctaagccatttttcctgtgtctgaaatagattaaccattgtgcctcttcgagttttttttctatctgtgtgttcacctttcttatgcacgcttgccttttataattaatttcaattaaacattagttttgtttaaataatactgtgtaattaaaatgcttatgtgctctcagagggcaaggaccatgtcttaatacactttagacatttttaaatacactaggctataacagcaataaaataattaaacatcgttttgttcaatctctacatattcacaattcctctgacactgaactgtgtataaactaaaatcagaaagctgctagttattttataatgcttctcaaaacagaagtcctcttccattggaaatgcagtctagcatcttaaaatctttttttttctttcaagaataaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaagcaactgtgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttacatatgtatacatgtgccatgttggtgtgctgcacccattaacttgtcatttagcattaggtatatctcctaatgctatccctcccccctccccccacctcacaacagtccccagtgtgtgatgttccccttcctgtgtccatgtgttctcattgttcaattcccacctatgagtgagaacatgtggtgtctggttttttgtccttgcgatagtttgctgagaatgatggtttccagctttatccatgtccctacaaaggacgtgaactcatcattttccattttgtccttttatttttgaatatgtaactcactgccaaattttatttgctctaatttcttattttagaaatgtcaagcctacagaatcattgtaagaatattacaatgaatagccatagacctttcacccatattttaaaattgttaacattatgttatatttgctttatcattctcttttaaaattttttttctttttttgccttttctgagccttagttgcctatttgtaacactttactcctaaatacttaagcatgtctctcttacgaacagggactttctcctatataaacatagtttaattactaaatcaggaaattcatcactattataatgttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaaatctacttttctatcttatcagatacaagtcttacttcagattgctatttgaattagaatgcctttagccatcttcattttcaggcttccattgtttaaaaagtcatgatggcttatccttaactgttatcaagcatgaatctataaatacctacaaatgtgttttctaaaaacaaaaaaattatggtgtttacatatagaaatgtatgttgccatagtgttcaataatccagagcaatgcttttcagcctatcttccttgtaaaaagctgttcaccttaggcttttgtagcggtgctttgtaagttctacgtttttttccgattctgttttagaactctatttattttaaaaatttacaaaaatagcacccatgttcaaagacctcaaaattagtaacttgtaagaccagatgaattcatttttgtgtacaccccagaatgtagtttatctttgcatctttaatggcaaggtattctaagactgcaagagatgctattttaactgttaagatttgtagatacttatttgtgaaaatctggattttctttgtatgatacaactaaaacaaaatgtgtaaatcatctggatgttttgtttaataggactgtagctcttctataaaatgcctggtgttagatgttaatgtttattcaaatagtctcattgttcttttcgattaacttataaatcaatccccactaatggaacactactttaatatgcttgaaaaaatgtttagtcttggggaaaaaagctttaaaactactgatcttacagaaaatgtccatttcaatatgtaaatttagtatacccattatttaaaatgtgtgtgtgtgtgcgtgacacttttaaatgcatttgtatttgctatcatgggacattgaatcagggttttatttttttattttttgttttttatttttaattttgagatggagtcttgctctgttgcccaggctggagtgcagtggcacgatctaagctcactgcaacctctgccttctgggttcaagcgattctcctgcctcagcctcccaagtaactgggactataagtgtgtgccaccatgcctggctaatttttttgtatttttagtagagacggggtttcaccatgttagccaggatagtctcgatctcctgacctcgtgatccgcccgcctcagcctcccaaagtgctgggattacaggcgtgagccaccatgccctgtcgagtcaggattttaaaactagctctccctgatctttttttttttcgatgaagtctcgctttgcacccccaggctggagtgcagtggctcgatctcactcactgcaacctccgcctcctgggatcaagcaattctcctacctcagtgtcctgagtagctaggattataggcgcccaccaccacacccgactaatttttgtatttttagtagagacggggttttgccatgttggtcaagctggtctcaaactgccgacctcaggcgatctgcctgcctctggcctcccaaagtgctgggattacaggagtgagccaccgtgccgggcctctgatctttataaaaataagataaatggtgaaaattgggaattcttactgctcttatgtaaaaacaagaataattttagtggtctgaattgaagggtcatgagaagcagcaggtatactaagctgtaaatctgtgggactaaactataaatcgtggacaagtggtcaagcagcctttaggaaggcaacaatatcatggcaatactctatttctgagctgatgttagagtttgtattgtcaataagatcatggtaaagtttaaccacaagttttgcagcctttcatgtttcctccatactcgtggaatattacccttccaacacagacatttcccttttaatagagggttatccttattacctccaccacattcactatccattttatatccatatcttgatttctgcccttctaattagtctactttgagtaattaggataaagcatttctgaaatttcattatataagcattaattactgtctcttaggtctaaaataatttttcggtcacattttctaattgccaaaattattccttggatcgacattcatactatttttctacaaacattatattacataaataaaaagaaaaagtttatatatatatataagtattttatggatgaaggtaaaacatgagataatttccttatgtatggaacaactaatattaaattaattctttaaggttgtatttatagctctcttatgcaaggagaataacttaagcaaaatagtacaccagataactgttatgtggtaatagagagattgaattaacactaaaatgtgttaaaacacatatatttataaaatagacttaaatttcaagaaataaaattaatactgttgaaagaagtgtagaaatcatatagtgactttaaaagtacacaagttcccctcatttcaaaggtgtgaatcttttgtgacttttatactagtatttaatactatataaacctcactgtttattctaaatattttattttattttattttattgtagagacaatgtctcactatgtcactcaggctggagtgcaatggcacagtcttggtcactgcaacctccacctcctgggctcaagctgccctctcatctcagcctcctgagtagctgggactacaggtgcatgccaccacacccggccaattgttttgtatttttgtttgtttgtttgtttgtttgtttgttttgagacggagtctcgctctgtcacccaggctagatggggtgcagtggcgcgatctcggctcactgcaagctccgcctccggggttcacgccattctcctgcctcagcctcccgagtagctgggactacaggtgctcaccaccacacccggctaattttttgtatttttttagtagagacggggtttcaccgtgttataaccaggatggtcttgatctcctgacctcgtgatccgcccgcctcggcctcccaaagtgctgggattacaggcgtgagccaccgcgcccggccttgttttgtgtgttttgtagagatggggtttcgccatgttgcccaggctggtctccaactcctgggctcaagcgatctgccctcctccgcctcccaaagtactgaggttacagacatgagctgctactcctggccaatatttcttatttatttatttaaaatatttagtgagtgcttacagaacgtgccggctacttttctaggtactggggtgggggcagggagaaaaagacccctggggtatatagtctacttgggttagtgttagagtagaccattgataaatgtatttgttttgtaaggggatgggggaagccacattttctagttttcaatatacctttataaatggagcatttgctttgataaaattgcaattctgttaacgtctcttaaagtattttgtttctccacaagggattattcagtattaatcattcaatgcgtacgatcagtgaaatcttagcaggccaaggataactcttgtgatactcgtaaaacaaccagaacagataccactttacaaataaaggacggtgtggggatctactgtggtggttagaaaagccctgaatatctgatttgtgactaaaatgtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctcatcttgctaaaaataatacagtaacaggattagtatgtgtatcatctgtatgaattaaccatttatttttattaaaatactaagatccatattatgaccacccttatgtgttcattgtctacttgtttgaatcaagaaacattctggcctttgatttcttgtagttatagatatatggaattggtaatgttgattgaaatataacatagtccctttagcttcagtactttaggaaaaggttcctctgtccactataacatttctcaaacccatgtaaaaacagtagtgtaaatataagcatacacaattaaatgagtgaagtaaaactcattggtgtgactatcagggctttaaaaaagtgtgcagtttgaaaaaaaatgaaggtgattatatagtaaaacaaacatctgtctctttcctactatccctgcactatgtataggacttgcttaattagaaagaagaagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtgaggattaaatgtcagccattgctattgttgttgttaggaggggagttaaatggattttggttttggacagaaaaaatggatttggtttgtaaaagtaatcaaatataagcagaaatatctgctaagctattggagagactgaatagatactaggtgaaagggaagagtaagagttgttattttgtgagtccttgtttttgtttgtggttctatcacagaatacctgaggctgggtaatgtataaagaacagaaatgtattttctcacagttctggaggctaggaagtccaagatgaaggtgatggaatttcgtgagggctctcttgctgcatcctctggagggtgccacggacaatgccatgtcctcaacatggtgaaaggtggaagggtaaagagacaaaaggtggccaaacttgccttttttttttttttttttttttggagacagagtttcgctcttgttgcccaggcacgatcttggctcactgcaatctgcgctcgcctcctgggttcaagcgattctcctgcctcagcctcctgagtagctggcattacaggtgcctgccaccatgccctgctagttttttttttgtatttttagtagagatggggtttcatcatgttgcccaggctggtctcgaactcctgacctcaggtgatccacccgccttggcctcccaaagtgctgggattacaggcataagccaccactcccggccccgaatttgcccttatataatgggattagcctacccagtgggacatagcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagtagctgggattataggcacctgccactacgcccagctaatttttttcttttttttttttattttttatttttagtagagacgggtttctccatgttggccaggctggtctcgaactcctgacctcaggtgatctgcccaccttggcctcccaaaatgttgggattacagacataagccaccatgcccggccctagaaattagttttaaaggatattttacactagtttttcatcaggaaaagtatatcttgataaaatgtttttctaattttagaacttaaagggaaatgtataactacattaaagtataggtagtagtaataatcttatagctaattttaagactctgccactaaggtgttataattcttagctccttctcacacatttgttttctaacataaatgatgtgtaacggcagagatcatgagttacatgttcctcatttgccttgtcatatcacctagtgcaaacttctcacacctgtaacctggaatgataataatttatttacttctttgtctcttttaggacactgtgggatatttgaaggttagagcttggtttctatttctatgccagacaaatcttacatagggtttgatacttagttgttagccagtaaaaatctaggacggctcctacaagaaacatttaaagggtttggcaagacctagggccaaccacctcccaacccgtccccaccctccaaaatgttttgaggaaaattaacacccctattattattagggaagcatgcaaattgtgtaagtaaaattataagtcagagaaaatcgaaatgtccatgtggaatagttaacatctttttgtttctgttatttcagggactgtcatatccaagaggataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggctgccttatgctgtgtccctcccacgaggggtcacatagaacactcttttccttcagcagtgaaaatgcagcaatatatgtgtgatgcacctgcccaaggaagcccattagagagtcagtgcccaaggtttttattgggggccggttatgtagacacactctgtttagcatgtaccaagatttcagactccccaaagtaaagcagatattcaatatagactgcattgtttgtacaaacaggcatagtaaaccatccttatcagctaaggagcagtggggacactccccaaaatccaggttcccagataccagccaagggccaactttgcatgcaagcctttctataaatagcagtagtaggcttgctatgtccacttttctgcatagcatggctttgtatgaatactgctttaggcgggagaaggaaactgtatggcatttctttcagtacttagtcttaggctcaatttgttagggagattaaggtttcttttctttgttagaggtgcttctaatgtcttggttgttttaagtgcctgttcgtcgacttgcatcattgctgaattccttttttgaactttatgaatgtaccaaacatacctgatccccactcccccaactagagcttgaaagcttgctgaaagtacagggcttaaactccacgtctccttgcaaatacagtatctaggcatattctctgttgattcctggtttcaggtagttgtttgagttccatataatattatgttggcttttattcagatcgtgcaattttctttattttggttggtgggctggggtattcatagtgcaggacctaagaaagcagtaaagcaaagaaaaaagtgagaattccagaaaatctgggtatattattatagtatcacatgtcctaaaatgttcaaaatttaatttcttttttgttttttgtttttttttttttgagacagagtttcgctcttgttgcccaggctggagtgcaatggtgcgatcccggctcactgcaacctccgcctcctgggttctagtgattctcctgcctcagcctcctgagtagctgggattacaggcatgtgccaccacgcccagctaattttttgtatttttagtagagacagggtttctctatgttggtcaggctggtctcaaactcccaacctcaggtgatccgcctgcctcggcctcccaaagtgctggaattacaggcatgagccaccatgcctggcttcaaaatttaattgctgagctgtttagatgaatccctgatagcatctccatggtgattgttagaaaatcatctttgattactgcttcatgtgtttttctgtaataacacattttctgattgtaaaggtttctatcaattggtcattaccttgttgcttttggaagaacaattatggctgttttatattcaacagaggcccccttatcagaaacagtattgtcttcactttgcaaataattgcagtattgtcttcatttttgcaaataaagagggaaaaaaaatcctatgtatcttagagaattgtgggtgtcaactcaggttctcacccagttaattgtacgttttgaaaatttaaaaaaaatgaaagggctattgacagtgagatgtgacagctaacaggagaaggaggaactataaaaatatagtagtcttcagttgtttcacagagaggaaaacaggcccaggctcttcagtggttttggagggcagtgctgtatgattgcgcagaatagaaattgatcttgatgaggtattatcaagaggagattcaatgtactcctcatcagtgctgtctgtgtgtaatattttcaaaaagttttcatcgggaatggttagctttctccccccttttagttgttatacttaaagagatatctttgacgtacacagcacacattcatggatcactgattatgcctgataaaggactcattgtattttgctctctttatgaaaactcatggaaaaaaataggtatctataacttatttagcacttagtataatcaacaatgttatgggtacaacaacagagaactacaccaaatgaaagagggagtttccagaaatatttagtaaagtttggagcatgtttttcatgctcaccatttccccacattaatatttctgagattaatttccaaagaaaataattggtcaccaaatatattgttttaaaaaatgtttcatgtttttgctgaggcaaagaagtcttaacactttgtggagaaagggaaggcaattaatcattgaaataagataaaagatacttcagccacttgggaggctgaggcatgaggattgcttgaacccaggaattggaggctgcagggagctatgatcatgccactgtcccccagcttgggtgacagtgagactccttttttttttttttttgagactccttaaaaaaaaggattaaagatgcttgaaccttggtgccatcccatggggaggaaaaaacccctatttttcagatttctgcagtgcagttctttggctagctggtagttgtacttgattaagtagaagagggatgatgctggttttattacataatggtctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtcaaggaataaacataatgggatggcagtagaatccctttataatgctgctgttacatggacactatctgttatgaggactgattttgctatatcattttactatatagagtaataatttcaagagcaataagttttttaattttttattttttgagacagggtctcactctgtcgcccaggctagagtgcagtggcgtgacctcggctcactgtatcctctgtctcccgggttcaagcgattctcctgcctcagcctcctgagtagctgagtagctgggattacgggcatgcgccaccacacctggctaatttttgtatttttagtagagactgggtttcgccatgctggccagcgtcgtctccagctcctgatcacaggtgatctgcccacctcagcctcccacagtgctgggattacaggcacaagtgaccgtgcccggcccccttccactttttaaacaacagaaatgaaacttattaagtaggggccttcgatctggaggctgggaagtccaaggtctatgtgctagcatattccttttttggtgagggcccttttcctggctttcagactgttcccttctcactgtatcctcacatattaggaagaggaagctttggtgtttcttcctcttataagggtgctaatcctatctggggtttccaccctcatgatgtcatctaaacctaattacttcccaaagatcccacctcctaatacaatcacattgcaggttggacttcaacatttattttgcgggggacataaacatagtccataattggtgttttcataaaaagaccatatatcaaacagtagtgtggtgcacagtaaataagtgccatgggcgttcagattagagaaaaactattgaggtgagacagctagtaaggtagaaagacagacaatgtgttgttcatttatgtatctggcttaatctgttcaggctgctataacaaaataccatacgtggattagcttatacacaacagaaatttattgctcaaagttctggaggccaggaagtccaagatcaggatactaacagatttgatgtatggtgaggacttactctatgcttcatagatggcaccatcttacaaccttcttacctgacaaaaggggcaaacaagttcctttgggtctcattatgtggcactaattccattcatgaaggttccatcctcatgaaatagttgcctccccaacggccctaactcttaatactattacattgggattaggtttcaaaataaattttggggagacataaacattcagaccatagtagtattcttagtgccgagtacaatgcctgaaacaaagtaggcattcaagaaaggtatgctaaattgaagaattaaaaatcatggaaatagatattttgaattggcaggcatcttacaaatcaggtagtccaagttgcccagaccatttcaactccgctaggaacattaaaataacacaaagccattttacactcattaaattgccaaaaaaaaaaaaaaagtctgataataccagctctcattttctgctcatgagactgtaaataggtaaaatcatgttggagagcaaattggcatcattaactgaagttaaagataactctatcctgtgatataacaaatctcatttaatatacagactctagagaatgtctcacctatgtgattgattgtattagttttctggggctgccataacaaactaacataaactcggttgcttaaaagcttagaaattcattgtctcatagtcctggaacccagaaatctgaaattaaggtatcagcttccctccctgtgatggctctaagaaagaattcttccttacctctttcagctttggatggatccagagattccttggcttctggctgcataactccaatcttttcttccaaattcgtgtcatcttctgcttttcctagtgtaactcttctctgtatgtcttttataagtttatttgtcattggatttagagcccattcagataatctaggattgatctcattttgagatccttaattatatttgcaaagatcctttttccaagaaaagtcacattcacaggttccatgagtttgaatatggacattttttttggtggccaccattcaacccactatttcagcaaatatttaaagcagtggtctgtaccaaaactaactatgacctccctgtcatttgttctggtcttctagttccttgtaggtcacaggttatctcactgcaacttcagtaataaaaaaatttgagggaaaagtgatagtagctttatttcattacttatatatttcttgagactagttttatggcctggcatatagtctattctggttaatgttccaggttaatgttccagttatgcttgaaaaaaaaggtatagtctatatttggttaaagcatttcataaacatcatttagatcaagtcagttggtagtgatgttcaagtctcctatttttttaaaaactattttctgtctacttattctaccaattattgaagaggcacagcgaaatccccaattataattatggatttatctatttttagttctatcagtacatttgcttcttgatttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgcatcttaacttatgacagtctagctttatatagtattgtatactttttctataagcaccttgcaatagcatccttatgtttgcacccccatcttttttattcttctcagacattttacttgtatatatgttataggtctgaccatacatcatattaattttttctttaaataatttgttttggggaaaaatagactgtaaacaatctcttatatattctcacactctatttcacacacatttctggcactcttcattcctttatgtagatctcagtttctatctgatattaattttctttagcctgaagaattttctttaagtatttcttatagtgcaggttttcttgcattggattttgcactgtatattttcagattatgtttgtctataaatgtatttatttcaccttcattttggaaagacattttcacaggttgcagatttctaagatgacagatttctctttttttttggtttgttttctttcagaaatttaaagatttcatccattgtcttctgagttccattttttttttcatttagaaaagacatttgggccaggtgcagtggctcacgcctgtaatcccagcactttgggaggccgaggcaggtggatcaccgggggtcaggaattcgagagtagcctgactaatatggtgaaaccccgtctctactaaaaatacaaaaattagcaaggcatggtagcacatgcctgtaatcccagctactagggaggctgaggcaggagaatcgcttgaactcgggagccagaggttgcagtgagcagagatcatgccactgcattccagcctgggcaacagagcaagactctgtctcaaaagaaaaaaataaaaagaggtttaattggctctgcagaatgtataagaagcatagatacttctgcttctgtgggggtcccaggaaactttcaatcatggcagaaggcaaaggagaagcaggtacttcttacatggaaggagcaggagcaagagacggagggggaggtgccacacactttaaaaaaatttacaacagtcttttttctttttcttcaatttttaagttaaagggtagatgtacaggatgtgcaggattgttacataggtaaatgtggagttgcattgtttttgataagaagtcaccaatcattttaaactctgttcccctctttgtaacatgtctgtctttctgactgctattaatattgttttatcattaggttttgacaaagtgattatgatgtacttttgaggtgtttttaatttttacaaatgtttatagtcagctctctgtatctgcatctgtggggtattggtgcaggaccccctgcaaataccaaattctgcagatactcaagtctcttacataaaatggtgtggtacatttggctctccatatctgcgggttttgatctgtagttggttgaatctgtggctgtgaaacctgcagatatagggagccgactgtatctcgtttgggattctttccgttcttaaattcgttggttagtagttttcatcaaatctggaaaattatgggccattatttcttcaactatttgttttgatctatcccttcaacattttggaaattttttctgtagtagatcactttatattgtccatatgtcactgaggctctgatagtttttttagcctttttttccctctctgtgcttcagattggtagttctttttaccattatcttaatttcactcatcttttctattgaagtgtctaatctgctggtaagccatacagtgaaaatttcatttcagatatggtatttttttcagttctcgagtctcatttgatttctttttttttgtagtttcatttctcttatttatgttaatgttttgctttatatcttgtatataatactaatatctgttttaaagtgcttacctgctattcccatcatctctgtcatgtctagatttatttccagtaagcaatctttttctgcttcttcaattacctagtaattttttgataggatgctagttattagaatgcgacattgttgaatgttggaatttggttgtcttaaaagagtattaggctttgttctagcaggtagttaacttacatgcaaatcaacttgatcatattaagacttgtttttaaactttgcatgaatctaaagtagcatttactctggatatggtttagtcctacttctaacatgtgtcctttttctgatttccaaatgctcaatgaagtctctcccctctgactgatcagaactcaaatgtctctcggtcctgtgtgatcttcagtgggtatttattcttctctggtagttcttctgatagttgttctgtgcccattctcgtggagtctcctctaaacttgtacggattgatattcagccagactcaactagactccactgcagatatctggaactgtttttttttttttctgtggggattcctcttctctggtaatgtgccctataaatccaagctgccactgccttcctgatctcccatctctcttttttcagttctgtaagcctgcagtactctgcatggtttgtcccctccctgcactgtaatgtgtacttccacacacaaaggctgggtggctatagggctcacttaatttgtttcctttctctcagggatcacagccctttgcagcctgttgcccaatgtctaaaaacagttgtttcatatattttgtctgattttctagttgtttacagatggaggtctagtctagtaccagttacttctttatggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctattaaaaatacaaaaattagccgggcatcgtggcgcgtgcctgtagacccagctactcgggaggccaaggcaggagaatcacttgaacccaggaggcagaggttgcagtgagctgagattgcgccattgcactccagcctgggtgacagagtgagactccatctcaaaaataaaataaaatgaaataaacctttcttaattctagaaaattttacatatattattatatataagattatatataaaatatataaattaccatgggttaatcctataagtttaatcagtaatgtagtgatccttgttgtttctacaaaataattcttatatgtgtgagagacatttacatgctgaattcgtaggtagtctgtttcaagtaaaagaaaaccattacaattgtgacctacttttttccatttgattttattcactaatagccatgtgttttgatagtgtataaagcaacattttattagtttctcaaatcccttgctatgctcttttgcagaatgaaatttttcactatttatgtcatactggagaatatagaatgtgaaaatataattgtccacttctcttaactgcaattatagtcgaatagtctcacaagatacatttttttttccccagatgtaagtgaagcctcttttgagttcagagctaaaattaaggactattttagattgagtccccaggacactcagtttttcattctaggtagcactatctcatttttacatttcctgtgttgtctctgtagatggttagaaaagcatacttcatcagaacgatgggttactgccagcacccctctgtgagatggttattaaaagcatgtcctttcctctccaattcagagtgcaaggttttcactgatgttatatacttgagctcttctgacacaagggagaggatagctaaaacagctctcaaagctgggtttatagcctttcctatcatttggcatttcactgaactaggtgaggtggttcttaatctttctctacctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacccagttcaagaaatagaacaatactgtctcttcccaattcctactgtccttgtcctccctaaagacttccagtaatttgacttggaacagtacagtttatttctgcctattttttgagttttacataaaataaatcacagagtatctacttctacctatctggcttctttcacccaatcccatgtttgtgagaatcattcacaggcctgagtataactatagttttaaattttgttcttctgtagctggggttgggcaccttattctaataagccgtaaatattttaggctttgtgggtcatatggtccctgacacagctttcgtaaaacaaaaacatcaatagatgatatgcaaatgaatgtgattttgctctattaaaactttatttgtaaaaataggcttcaggctagatttggcctatggactgtagtttgccatacatgcaataaataaatagaatactctagtatactgtagtatttcattgtatgaatatatcacaattagctgagccattcaaatattagcagacatttgtgtttttggtatgaatgcccttggaatgtggttttgtataaatatgcatgcatttctgtttggtatatggaattgcctcatgatagggtatatatatagggtaaacttaagtagtattgccaaatggttttccaaggtggttgtattagtcagcgttctccagagggacagaactaataggataggtgtatacatgaaggggagtttattaaggagtattgacccacatgatcacaaggtgaagtcccgcaataggccatctgcaagctgaggggcaaggaagccagtcggagtcccaaaacctttaaagtctggaagctgacagtgcggccttcagtctatggctgaaggcctgggggctgctggcaaatcactagtgtaagtgcaagagtccaaaagctgaagagcttggagtcttacattccagggcagggagcatccagcacaggagacagatgatggccggacgactccgccagtctactcattccaccttcctctgcctgcttctatcctagccacactggcagctgattagatggtgcccacccagattgagggtgggtctgcctctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgcatacatccatatacatacacatatatatttatacacacacacacatacacacacatatatatacacatacatatataatcataggtgtaagtgctatcccgaaaagaaatagagcagagtaaggagtaccatggggtgggtgttgcaattttaagtaggatgatcagggtgggccttgtggagaatgtgatacttgagcaaagatgggaacaaggcaaggtagtgagccaagaagatatctggtatggttatatttagtaggtttttttttacttgtttctcactttactcctgaaaggattcagtgcctgcattatttaggtggtcaaaactaaataaaaacttgatatattaacattttattcctttggtaatatagggggaccatgctaaagagaacttagtccactctggggaagtgctacgtcaaacttttgtttgactgtcagagctctcactggggtacctaccatgctgccacggggtggagtatttcactgtaatgtttctataccttatgaaattgacttagattgaaaatatcccaccactttagcccctgagcctgattctttttaagtgcagattttctaatctaaaaatcaaataagagagaatatgagaaggttcaatggaaaatcctaggtaatgtatagctgtgtaacagtgactctttggaaacgtttcttctgatgttattatctattgagtggaataatgctgattatttctggttagataaaggggaaggcagataagaccttagggtagcccataaatcacatagtataggaaattaccttttccaattatgtagaagctgcccttgttgctgactttccccattattcaccatcactataattgggaaaaccagaaagcttggcaagagaaatttgaatagcgagctcttagtttgttatgttgctgctatcactggtataaacacaggtgtagttttacaggatgtttggtgattattctatgcagaaacctaatagtcgtgtcacaaatttctacctcagtatccagaatcctataatctgttttgggaattttccttttacttatatgtaattttacagataaatcctcagttttctagtatggcatttcaccactgatgctgaaattagaacattgagggcttgtaatttgaaaatgtaaagattagaaattatatttcatagtcgggtgtggtggctcatgcctgtaatcccagcactttgggaggctgaggtgggcagataacctgaggtcgggagtttgagaccagcctgactaacatggagaaaccctgtctctactaaaaatacaaaattagctgggagtggtggcgcatgcctgtaatctcagctacttgggaggctgaggcaggagaatcactgaaacctgggaggcggaggttgcagtgagctgagattgtgccattgcactccagcctgggcaacagtagtgaaactccatctcaaaaaaaaaaaaaaaaaagaaacaaagaaattatatttcatttgtcctgtctatatatgatccaatgtacttttgctttctggcttctggtttctgcattttttttttttttgagacggagtctcgctcggtcatccaggctggagtgcagtggcgtgagctcagctcactgcaagctccgcctcccgggttcacgccattctcctgcctcggcctcccgagtagctgggactacaggcgcccgacaccacgcccatctaattttttgtattttcttagtagagacggggtttcaccatgttagccagggtggtctcgatctcctgacctggggatccacccgcctcagcctcctgaagtgtagggattacaggcgtgagccaccgcgcctggccctggtttctgttaaactggacatgccactttaacattagctcattctttatttgcttagccaattatatacatttttacccttgcaacaaagaaggataggcatagatgttctggacttattgttgaaggagaatccaggttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttattttagcaaataaactcttgaatccagcaatcccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaaaaaaaaaaaaaaaaaaaaaaaaaaaaaaagtctccttgtgatccttaaaaaaagatttgagccctgtttgaggttgatcttttatatgaattaaaagtaattatatctcaaagaatcagtgtaaaatgtatgtattgtttggtttcatgaccctttgttattacttaccactctaccactgcagttcctaggtactttaattcagttgccatccttcccactctctctgagctccataatagtgctgatttaacaaatactcactaaatagacaaaaccctacttaccattaattatgaactgaaatgaagcataaatgtggaataaataaaggatataatgagaaaatgtacaaaatgcttcaaatgcaccagtacccattatatatcactctaaaaattaatcattatattaaagttatagtgacaaaatgttttttactaagcagaagtaaaatttttgtgcattctttctctatcccacctcatattttgaatatatctgcaaagctggtttaaatcttgcttaaaattttatgttaaaaaatgtatgcacatcacataaacatggtaatgctcaattgtccattaaggaagacatttcacattttcaacatgaatgcttttctattctaaacatttttattaagccatttattcaaccagaggcctgcacagtaagcaatagtgtagttgtttttcaactagtactctgtcaggaacttagatagaaataccacattgagaaaaaaagtctttaacagaaatctaaaaacaatcattggtgttggactgtaaaattagtttagagttggattttatgactttttaaggatactacctgtaagttcttttactatttttaccatttctcttaaattttcttctattgatggttgttttaaattacgtgatgccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggttaaaaaaaaaaaaacataacctgagatctaccctcttaagaattttttaagtgaatagtacaatattgttaacgacagatataatgttgtataacaaatctccagaacatttacatcttgcatgactgaaactttatgcccattgcaccacaactctttttttttctttctttctttctttttttttttaatcatactttaagttctagggtacatgtgcacaacgtgcaggtttgttacacaggtatacatgtgccatgttggtttgctgcacccattaactcatcatttacattaggtatttctcctaatgctatagctccccctgctccccaccccatgacaggccccagtgtgtgatgtgccccaccctgtgtccaagtgttctcattgttcaattcccacctatcagtgagaacatgcagtgtttggttttctgtccttgtgattgtttgctcagaatgatggtttccagcttcatccatgtccctgcaaagaagatgaactcatcattttttatggctgcatagtattccatggtgtatatgtgccacattttcttaatccaatctatcacagatggacatttgggttggttccaagtctttgctattgtgaatagtgccacaataaacatacatgtgcatgtgtctttatagtagcatgatttataatcctttgggtatatacccagtaatgggatggctgggtcaaatggtatttctagttctagatccttaaggaattgccacactgtcttccacaacggttgaactagtttacactcccatcaacagtgtaaaagtgttcctatttctccacatcctctctagcatctgttgtttcctgactttttaatgattgccgttctaactggtgtgagatggtatctcattgtggttttgatttgcatttctctgatgaccagtgatgatgagcattttttcatgtgtctgttggctgcataaatgtcttcttttgagaagtgtctgttcatatctttcacccactttttgatggggttgtttgtttttttcttgtaaatttgtttgagttctttgtagattctggatattaaccctttgtcagatgggtagattacaaaaattttctcccatcctgtaggttgcctgttcactctgatgggagtttcttttgctgtgcagaagctctttagtttaattagatcccatttgtcaattttggcttttgttgccattgcttttggtgttttagtcatgaggtccttgcccatgcctatgtcctgaatggtattgcctaggttttcttctagggtttttatggttttaggtctaacgtttaagtctttaatccatcttgaattaatttttgtataaggtgtaaggggggaatccagtttcagctttctacatatggctagccagttttcccagcaccatttattaaatagggaatcctttccccatttcttgtttttgtcaggtttgtcaaagatcagatggttgcagatgtgtggtgttatttctgaggcttctgttctgttccactggtctgtttctctgttttggtaccagtaccatgctgttttggttactgtagccttgtagtatagtttgaagtcaggtagtgtgatgcctccagctttgttcttttggcttaggattgtcttgacaatgtgggctcttttttggttccatatgaactttaaagtagtatttccaattctgtgaaaaaagtcattggtagcttgatggagatggctttgaatctataaattaccttgggcagtatggccattttcatgatattgattcttcctatccatgagcatggaatgttcttccatttctttgtgtcctcttttatttcattgagcggtggttggagttctccttgaagaggtccttcacatcccttgtaagttggattcctaggtattttattctctttgaagcaattgtgaatgggagttcactcatgatttggctctctgtttgtctgtttttggtatatagaaatgcttgtgatttttgtacattgattttgtatcctgagactttgctgaagttgcttatcagcttaaggagattttaggctgagacagtggggttttctaaatatacaatcatgtcatctgcaaacagggacaatttgatttcctcttttccttattgaataccctttatttctttctcctgcctaattgttgtcctggccagaacttccaacactatgttgaataggagtggtgagagagggcatccctgtcttgtgccagttttcaaagggaatgcttccagtttttgcccattcagtatgatattggctgtgggtttctcataaatagctcttatgattttgagatacattctgtcaatatctagtttattgagaggttttaggatgaagggctgttgaattttgtcaaaggtcttttctgcatgtattgagataaccatgtggtttttgtctttggttctgtttatatgctggattacgtttattgattttcgtatgttgaaccagccttgcatcccaggatgaagcccacttgatcatggtggataagctttttgatgtgcagctggattcggtttgccagtattttattgaggatttttgcatcgatgttcatcagggatattggtctaaaattctctttttttgttgtgtctctgccaggctttggtatcaggatgatgctggcgtcataaaatgagttagggaggattccctctgtttctattgattggaatagtttcagaaggaatggtaccagctcctccttgtacctctggtagaattcggctgtgaatccatctgatcctggactttttttggttggtaagctattaattattgcctcaatttcagagcctgttattggtctattcagggattcaacttcttcctggtttagtcttgggagggtgtatgtgttgaggaatttatccatttgttttagattttctagtttatttgcatagaggtgtttatagtattctctgattatagtttgtatttctgtgggattggtgctgatatcccctttatcattttttattgcatctattcaattcttctctcttttcttctttattagtcttgctagtggtctatcagttttgttgatcttttcaaaaaccatctcttggattcactgatttttttgaagggtattttgtgtctttatctccttcagttgtgttctgatcttagttatttcttgccctctgctagcttttgaatttgtttactctcgcttctctagttcttttaattgtgatattagggtgtcaattttagatctttcctgctttctcttgtgggcatttagtgctataaatttccctctacacactgcattaaatgtgtcatagagattctggtacactgtgtctttgttcttattggtttcaaagaacatctttttctctgccttcattttgttatgtacccagtagtcattcaggagcaggttgttcagtttccatgtagttgtgtggttttgagtgagtttcttaatcctgtgtcctaatttgattgcactgtggtcggagagacagtttgttgtgatttctgttcttttacatttgctgaggagtgctttacttccaactatgtggtcaattttggaataagtgtgatgtggtgctgagaagaatgtgtattctgttgatttggggtggagagttctgtagatgtctattaggtctgcttggtgcagagctgagtttaagtgctggatatccttgttaacctgctgtctcattgatctgtctaatgttgacaggggggtgttaaaatatcccattattattgtgtgggagtctaagtctctttgtaagtctctgaggactagctttatgaatgtgggtgctcctgtattgggcgcatatatatttaggatagttagctcttcttgttgaattgatccctttaccattatataatggccttctttgtctcttttgatctttgttggtttaaagtctgttttatcagagactaggattgcaactcctctttttttttttgctttccatttgcttggtagatcttcctctgtccctttattttaagcctatgtgtgtctctgcacgtgagatgggtttcctgaatacagcacactgatgggtcttgactctttatccaatttgccagtctgtgtcttttaattggagcatttagcccatttacatttaaggttattattgttatgtgtgaatttgatcctgtcattaagatgttaggtggttattttgcccattagttgatgcagtttcttcctaccatcgatggtctttacaatttggcatgtttttgcagtggctggtactggttgttcctttccatgcttagtgcttccttcaggagctcttgtaaggcaggcctggtggtgacaaaatccctcagcatttgcttgtctgtaaaggattttatttgtccttcacttatgaagcttagttcggctggatatgaaattctgggttgaaaattcttttctttaagacttttgaatattggccccctctctcttctgtcttgtaggatttctgctgaaagatccactgtcagtctgatgggcttccctttgtgggtaacccaacctttctctctggctgcccttagccttttttccttcatttcaaccttggtgaatctgacaattatgtgtcttggggttgctcttctcaaggagtatctttgtggtgttctctgtgtttcctgaatttgaatgttggcctgacttgctagtttggggaagttctcctggataatatccttcagagtgttttccaacttggttccattctccctgtcactttcaggtaccccaaacaaacgtagatttggtcttttcacatattcccatatttcttggaggctttgttcatttctttttactcttttttctctaaacttctcctctcgctttatttcattgatttgatcttcaatcactgataccctttcttccccttgatcgaatcatgtgttgaagcttgtgcacgcgtcacgtagttcttgtgccatggttttcagctccatcaggtcatttaaggtcttctctacactgtttattctagtcagccatttgtctaatcttttttctaggtttttagcttccttgcaatgggttcaaacatcttcctttagctcggagaagttggttattaccgaccttctgaagcctacttctgtcagctcgtcaaagtcattctccatccagttttgttccgttgctgtctaggagctgcaattccttgcaggagaagaagcgctctggtttttagaatttgcagcttttctgctctgatttcttctcatctttgtggttttatctacctttggtctttgaaatgggtgacctccagatggggttttggtgtggatatcctttttgttgatgttgatgctattcctttctttttgttagttttccttctaacagtcaggtccctcagatgcaggtctgttggtgtttgctggaggtccactgcacaccctgtttgcctgggtatcaccagcggagactgcagaacagccaatattgctgcctgatccttcgtctggaagctttgtcctggagggtcacccgcctgtattaggtgtcagttggcccctactcggagctgtctcccagttaggctacacgggggtcagggacccacttgaggaggcagtctgtctgttctcagagttcaaacctccgtgctgggagaaccactgctctcttcagagctgtcagacagggatgtttaagtctgtagaagtttctgctgccttttgttcagctatgccctgccccccgaggtgggggtctacagaggcagtgggccttgccgagctgcagtgggctctgcccagtttgagcttccccagccgctctgtttacctactcaagcctcagcaatggtggatgcctctccccctgccaggctgctgcctcgcaggtcgatctgtgctagcagtgagcaaggctccatggacgtgggacccaccgagccaggcgcgggatataatcttctcgtgtgctgtttgctaagaccattgggaaagcacagtatttgggccagagtgtcccgtttttttaggtatagtctgtcacagcttcccttggctaggaattggaaatccccctaccccttgcacttcccaggtgaggcgatgtcccgccctgcttcgtctcgccctccgtgggctgcacccactgcccaagcagtcccaatgagatgaaccaggtacctcagttagaaatgcagaaatcactgtcctctgtgtcgatcatgctgggagctgcagaccggagctgttcctattcggccatcttggagagctctctgtttttttcttttttttgagacagagtctctctgtcgccaggctggagtgcagtggcactatctgggttcactgcttcctcctcctcccacgttcaagcaattctcctgcctcagcctcccaagtagctgggactacaggtgcacgctgccacatccggctatttttttttgttgtattttagtggagacagggtttcaccacgttgcccaggctggtcttggaactcctgagctcaggcaatgcgcccaccttggcctccagtagtgctaggattacaggcgtgagccaccgcgcctggcctgaacaacaactcttgtatttctctctcaccccatcacctgtcgacaaccactttgagttttttttgatgagtttgactacttgaggtataaatggactcatgcagtatttgtccttaagtgactagcttattttaattaccataaagttagctatgttcactcatgctttagcatatgatagagcttccttattttttatgactcaataatattccaccgtatgtatgtatgtatgttttctttatccactcatccatctatggacatttagcttgttttctcctcttggctacaatgaataatgctgcaatgaacatgggagtgcagatatcatttggagatactgacataaattcttttggatcaatacctagaagtgggtataaggataaaagggtcaccatcttgctgttgtcattcccttatttgtctgtcttttgcatcagtatatgaagtaatagaaaattaattgaagaaggagagagatgcatatgaaaagatgctcaacatcattgatcatcagagaaatacatattaaaattacaatgaggtatcatctcacccaagttaaaatggcttttgtctaaaagacaggcaataacaaatgctggtgatgatatggagaaaagggaaccctcatgcactgttggtgggaatgtaaatcaatacaaccactatggaaagcagtttggatgttcctccaaaaatttaaaattgagctaccatatgatccagcagtcccactgctgggtatatacccaaaagaaaggaaatcagtatattgaagggatatgtgcactcctatgtttgttgaagcactatttacaatagtgaagatttggaagcaacataagtgttcatgaacagatgaatgcataaagaaaatgtggtacatatacacaatggagtactattcagccataaaaagaatgaaatcctgtcatttgcaacaacatggcaagaactggaggacattatgttaagtgaaataagccaggcacagatagacaaacttcccatgttctcacttatttgtgggagctaaaaaatcaaagcatttggactcaaggatatggagaatagaatgatgattatcagtggctgggaagcgtagtgatggggaagtggggatggttaatgtgtacaaaaaaatagaatgaataagacctagtatttgctagcacaatagggtggctatagtaaaaaataatttaattgtacattttaaaataactaaactaactaaacgtgtataattggattgtttgtaacacaaaagataaatgcttgaggggatagctaacccatttaccatgatgtgattattatgcactgcacgcccgtatcaccatatctcatgtagctcataaatatatacacctactatgtacccacagaaattaaaaattgaaaaataggcacacttccaggatcaaaaaaagaaggaaaaagatggcttaattattgtgagtttccaaatcatcagataaatatgccatatttaaatgcaaacaatgtcatattaactttttatatattggaggctattttctttcgggctgctataacaaagttatgttaatatgtcacccaccatagactgggtggcatatttaacaaaagaaatttatttctcacggttctggaggctggaagtctgagatcagagtgccaaggtggtcgggttctggtggtctgggttgcagactgctgacttctctttatattttcacatggtagaaggagggcgagagaactctctggggtccctaataggggcgctaattctattcatgaggtctctccacccttgtgacctcattacctctcaaagttccccccaatcacattgggggttaggatttcatcataaggatttgggggcacacaggcatttagcatttttgtaacaaaggaaaactatatactgtattcccctctgaaaattagtgaagtgtgttagctgttgaaacttctaagaagtctttggtttaactttctttcttttttttttttttgctttttttgagacggagtctcgctctgtcgcccaggctggagtgcagtggcgcgatctcggctcactgcaagctccgcctcggttcacgccattctcctgcctcagcctcccgagtagctgggacggcaggtgcccgccaaaacgcccggctaaattttttgtatttttagtagagacggggtttcaccgtgttggccgggatggtcacgatctcctgaccttgtgatcagcccacctcggcctcccaaagtgttgggattacaggtgtgagccgcggtgcctggtcagtttaactttctttaaacccagcatttcttaaatctctaggatgatgcaaaagtaattgtggtttttgccattaatggcaaaaccattacccagcaacctcttttggggttacccaggaacctcttttggggttgggggaatagtatccactaagtatccacttgtcttctgaggcaaggcactgcttttctactgcctacagttaggttagtgctgaatggtatatttaagtataaagtaaccccaggtcacatatggctacttaaatttaattaaaattgattaaaattattcagatcatcagtcacattagccacatttgaagtgctcagtagctgcaagtggctagcgactatttttattggacatatccataagaaagacacatattgggatccgttttgtcacctaacatccctacccccaaagaatttactgatttgttatttgtttttgtgattttacattaactgaataatgttacaaaactagtcttaaaaaaaatctgttgctgctttcaatataacaatgttgtatagcaatggtcccccaactttttggcaccagtggccgattttgtggaagacaattttaccacgggacgggcggggtgcggggatgtggggatcgttacaggatgtaattgttccacctcagatcatcaggcattagttagattctcataaggagtgcacaacctagatactttgcatgtgcagttcacaataggatttatgctcctatgagaatctaatgctggtctgacaggaggtggagctcagagagtaatgctcattggcccgctgctcacctcctgctgtgaggtatggttcctaacaagccacagtagtggtctgttgcccaagggttggggacccttgttgtagaggacagtgtgcactgttattgtgttttttgtatgaaaactcctatgagcccttttatttggttctaaaagttagaaaatcctttgcttctttgaaaagtaactgattatatttttatttccttttatttgggcaccagaaaacagttaaatctttgtcctaacattctttttaatctcattctattctgatttatatttttttctattcctgttttctctcgatatttgttttcatagttttgcaaaatacttcaaattccataagagcaaatcaggtataactgaacattagtgaattacagtcttttttcacaattcatcataagtggtcaacattcttggctgtccatttttgcagggcatttgatagttgagccatttttccattacaagtgtttctagtatcaatggttaagttttctgtattgtctgtaagctgtttcttgctcaggtatcttataatcaatagtacatgatacagaattcctgagaagtaggaatagaaaatctatttgtagtctgtgtttctccataaggctttagaagtagacgagactaagcagctttgtttctaattcagtatttggaacttattgtatattcattcatttactctttcatttattcattcattcagtaaatatttgttgaatgcctgctatgcactgagcacttttctgggtgctgaagatgtagcaagaagacaagaagacaaaaaaaattccctccctcaaggaactgacattttactgagattaagctcaaattccaattcattaaactcttaatttttgagatcattaaaagaaaagattgtctcttattggcatctcctctccacgtacaccgaaagttatttcatttccatggccttatttgctgtggcagtaagagagataaataggccaaatcgaactgggaggcaggaggaagaactcttgtccaactttcattgtattcaagaattcaagaatatgagtgagaaaaggctgataagaaatatagtttgttgatcctaggctgagtgcaatggctcacacctgtaatctcagcagtttgggaggccgaggcaggcggatcatttgaggccaggagttcgagaccagcctggccaatgtggcgaaatcccatctctactgaaaatacagaaattatttgggcatggcggtgcacgcctgtagtcccagctacttgggggaccgaggtggggggattgcttgagctagggaggcagaggttgtagtgagccaagactgtgccactgtactccagcctgggtgacagagcgagactctgtctcaaaaagagaaaagaaaaaaagaaatacagtttgttgatcctaaaatatttggagagcagatttatggtcaaaataagacatagtctctgagacctactctgttcttagaagtaatcaggaatatttatagttgattggttttcaaaacaaaaatgcaaagcagttaaatatatatttgctaaacttattgaacacttagtatatgacagtgttctgaatgctgaagatagatcaatgaacaaaacaacaaaactccctgccttggagcttgcagtaaagagtagaaaccatgagagcaagtaattgactaaggaagcaagacagtgagtgctgtggagagaaagtgctataaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgataatggattaataactttatgagtattcttatatagcaacatgaaacatgtgtatcctaatagaaatatgaacaaaggtattgaacatagtattcataaaatataagttacatatatgatgtgcatggtgtatatggtatgtatgagtgggcttgtatgaatgtggatggctgtgcatatattcagcctaattagcaatagaagaaatgactattaaaagaatactgcagtttaatagacaaaaaggatctaaaataatgatctgatatgtgagggtgcagagaagcatgcactctcatttcatgatggttggtttgtagaatagtacaacctttctggagggcagtttagcagaatgaaacataagcaatgaaaatatttatattcatgcctagcaattccatttctagaaaattgtcctaatgaagcagatgtataaaaaatatatctgtagtattcacttcagaattatttctagttgtgaaaaattagagcataaatgcccaataataaaggaattttaaaataattgtatgataatttaaataatctatataattatatgggagatgtttatgatatagtaaatgataaagcagaatgtaaaagatatgtacagccaatagtatgaccccaattttctttaagaatatattgcacatgggaaaaatgattagaccaagtgataaaatatattaacagtacgtctctctatgtgagaaattatggtgatttttaaattttcttctcttgcattaactctgttttccaaatttttaacaatgaacttgtattagttgtgaaatgaggcaaaaggaaaaaatgataaaggagaaagggttcaattatattatctttattctctcagtgttgcaattaatgatagaattaataagccctatttttgccttgtttaccaactttgagtttagcaacaggaactatttgtattccattatgtttataaaagatggaaatatattttctgttttttcttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaataagcttttccctccttcaccagtattaatgtttttctttctttttttttttttcttttttgagacagagtctcactctgtccctgaggctggagtgcattggcgtgatctcagctctttgcaacctccgactcccaggttcaagtgattctcctgcctcagcctcccgagtagctgggattacaggcgcatgccaccacgcctggctaatttttgtatttttttttttttttagtacatatggggttttgctgtgttagccaggctgatcttgaactgctgacctcaagtgatccactggcctcggcctcccaaagtgctgtgattacaggcatgagccaccatgcctggccgtattaatgtttttctaatacttccttaatcagataaaaatttcaatttgaaaaacttgaaatattgatgtaaattgtttgattactacatgtgttttcttttttttttttttttttttactattttgctaaagaatatggttagttataagttgatactatgtatatcttcatggagatttttaagtaggtttttttattggccctgtttatatgtgtaggaaattatgctaaatcacaaaactggaaacaagagctatttcttgctgtgtaagtcagtttatcaaaaatctagatagctgtaataatctttttttccttgttacatgagaacattctgtattctctatcccttaataatgattattttaagttatacttgaatgttccactggcattttacacttattatatctaatatggactttgtaagttttcgttattacctactctagtcactcctcatctgccttctatgtagtccttattactgttaacatcatcattcactcagttaaacaaatctgggtaacctgtccctcattccttcactctattctccagggtcaaccactcctccttatctatcagttcctgagtagtttcctgaatcttcaccttcatcttctctacatcctatctctgaactcatcctccagaatgccttcagaattacttttataaagcttagtctcctctctaccacttttaaaaaatataattcttttaattttgtccagtgttcaaataaaacactcctagaaagagtatttcttcatgaattcctttttcttatatcactatttggctcatactttcactgcatttttgtaatccaagtccccctaacacaaaatgagcttaaaatatggttattttggccgggtgtggtggctcacgcctgtaatcccagcagtttgggaggccgaggtgggtggatcactcgaggacaggaattcgagaccagcctggccaaaatggtgaaaccccatttctactaaaaatacaaaaattagccaggcgtggtggtgcatacgtgtaatcccagctacttgggaggctgaggcaggagaatcgcttgaacccaggaggcagaggtggtagtgatctgagatcacgccactgcattctagcctgggcgacagaacaaggctctgtctttaaaaaaaaaaagaaatgtggttttaatggttaaagccattaaaaaacccttaattatataaagcaaataataattacaattaggacatcagagaaaaatgcactttactatcagttaccaatatgtgaattaccacccttttacgttatctgtgagagtcaaactgtataccaccatgtaagttgaatatgtgtacactttgccttggggaggagctctaggctgatgtttctaaatggtgaggaacacaccacacctgatttgtaaagtcagagaaggctagagctggaatcgatcatttagtccaaaaccctcttaaaattttttaaaatttattttatttttattttttagagatggtatcttgctatgttgcctaggctggacttaaacccctaggcccaagtggtcctcccatctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctcatctcctcttctcttaatggatcagctcattctctcctattggagagaggcttcttgatttggccgaagtcttagttatcagcagcaatgagagcaaacagactggctggacaacaatttctgtgtttcaatgccagtgcctagtgtgatgttatttgtcacatatgcatgtggaagatgtcttggccaaataactttgggaaattttgcatgctctacacctgtcccctccctttgaagaatcacaatgcacattaacatattaaattatctgaaatgtcctatggtagaaaaattaattacctttattgaactcactgtttccaaatcttaggtgatttcagagcatttatcatcatccatggatactagtgtctcacaaaagagtttagaaagttggatgttataaaatttttatttcatttttacattgtagaattttctactcccctttcaataccaggcaaatcgatgtgatttctgtgaataagtaagcaagccatatacatttatacaaatatgcatcatttgatggaaaggcagcacattgttgccagggaaaattgtatctaaatgatgtttagatttttgtttggaatataaatggatagataaatgaaattattccacttatacttttaaaatgccactgacggaagaaaaaaaaacccatattatctcaatatgtattgtcaaaaagtccttgataaaatttagcatgctttccgattataaaattaatacaataggacaagtacttatttccttaactggctctttcttgttattcaggtctcagcttaagtatcactttgtcaaagaaacctttcctaacttcctgcatgaagtagctcccactccctattgtattagtctgataaaactatatattgcaagccaaatggcactgttctgtttaatgctaaaacacttgaagaattcccatgtgaagagccagactaggatgttcacaatcactagtattttttaggcttttttccccattttttagagaggaagggggagtgtgtatctgccaatgcaattaaataagagagagaaggaaataaaaagatttagaaagatatatgtaattttttcacattatgtgactatctgataaagtatgtaaaaatcaatagcatttacatatatatatgtatatatatatatatatataaaacaaggcaaatgattgtgtgtgtgtggtttttttgtttgtttgtttttgagatggagtctcgctctgtcgcccaggctagattacaatggcactatcttggctcactgcaaccttcacctcctgggttcaagtgaatctcctgtctcagcctcctgaataagtgggattgcaggcgcctgccaagatgcccggctaattttttgtatttttggtaaagacatggtttcaccatgttggccaggctggtctcgaactcctgacctcaggccatccgcctgccttggcctctcaaattgctgggattataggcgggagctaccatgccaggcctaaatgattgataatggaataaaaagtcctatttagtatagtaataagagagagtcaatgacataccaatataatttcaacagaatttttctttttcttttttttttttaagaaattgacaacatgatgtgtatttttatctggaagtaaacatctgggaatagccaggaaaaaactggaacggaagtgcactgaaggggaactagttctaccaaatatatatataaaaaaaggttaaagttataggattaaaatagtttattcttgtttataacagagtcaaatagtagaccataatatatgcaggaatttactgtatgatagatgaggcatttgaattcagtaaagatcagttattcaatccaaaatttaatttgataaaaggatcataaagttaaatattacattacaggctaaaaaatatatttgcaacacatatggcaaagggctcattatcttaatatacaaagattttttacaaaataaatatgagtgggccaggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcatggtggcgggtgcctgtagtcccagctacttgggaggctgaggcaggagaatgacgtgaacccaggaggcggagcttgcagtgagccgagatcacgccactgcactctagcctgggcgacagagcgagactcagtctcaaaaaaaaaaaaaaaaaaaaaaaaaaatgagcaaatgaaaacccctattaaaaaagtggcagagcccctgaaaaggtagttcatagctacagaaatacaaataagcaataaaatgcatgaaaaaggatttaacttcaaacagaattaaataattggagatgaaatcagcaatgacataacatttgaaaaaaaaagtaacaaattaacaaagttttaaaatgttcgataatggtataagagagaatatggaaagaaagctcttccttctattgacacagtttttttcttttgtcatctttttggaggggcatttcgtgatatctaccaaaattgggcccagcagttccagttcttggcacgtatcctacacgtaatcctatacaaatatgtgaaggtacatgtaaaagaatatcagatgaaatattgcccctcagtgaaagactggtaaaatctgctgttactcttcccctggcttagtgtgctccaaccacagtagctttctatctctttatgggacatacccagtcttttccaccttaagacatttgtactagctattctttcctcttgggatgccttttccctaggttttttacgtgactttttttttcttgtcattcaggtctcagcttaagtatcatttcctcaaggaagcctttcctaacttcccactacaaagtagctcccatttcccatcatagtactctgttttattgtcatcatagtagctattactatttaatattgtcttctatgtttacgtattatctgtttctctagaatatggaaaggcagaataacttggtaattaaaagcattgactctgtagccatagctgggttcaaattttggctctgccatttacagtctgttggcacttggggacaattctaacttaatctctagtgctttcactttttaaaaaaaatctgtgcaactgtgattaagaatagaacctacctcacaaatttgtgataataaaatgaacttaacatttaaaacacagcactattgaggacatggtagacactcataaaatacttgtagatcaattgaattaaattatcatttattcatttaaaagaatattatgaaaccatctcagtgaatgaggtagatctgtatgttctgatatgaattttcttcaaaatgtagtgtgagtgaaaatagactgtgaaggtaacctcaaaatctgggtctttaaacaacagagactcatttcttgctcatgttacatatctattatgtgtcagtgagggtctctgtctcatgttgtcctcactagtgtcctgggctccaccatatggcgaaaggaagtagaatattcagagtggcattttagatgcttccatctagaagcactaccctccacttatcacattgcattggccaaaataagtcacatagccacacctaacttcaaggagtaggaaagtacgatcctactgtgaccttctaaggaggagaaccagaaatgttgatgaacagcaattattaatgagaatgtaataattgagaaaaaaggtacaaaagagtaggtataaagagagcctatttttcaaagatgtgtgtgtacttggatttatattataaaaatgtatggaacaatctgcaaaactaatagtggtctgctctgggaaatgggatatttactttttacattaaaccttttgtactatttgatatatttttcaatgtggacatatattacttccataactaaaaaaaaaattgtctcccaactgcctctcacatatactttgacaaagtgctattgcaaatactattacaactcagtaaacatgggatggcttatattgagagaaggaaactgattcacaatgagagaaaaggggcagaaatagataggttattttctgggtagagaagtacagagaggggctcctaaaagaccagtggcaatactaaagttctttataaactatctagtagagaggattgtgtggtagaaatttacaagctttctagtaacaaagtttcctgggtagttaagtgccagacagtaggggcagaccacaaaaatatttttatatcattttgtatttggatagaagaaacatattaaggataatatatttctgaatagatatcagtgataaatttgaagattctgaactattgcagaagactgggaaagttccctgaaagtctccatttttccatgatttcataaaagttgctgttggcaatgattccagggcttttcccaacttggaaattcttagttttcaaagtactttaaaagtaagatataaaattattttaagggaaaatgataagataatgttttatccaactctgcttgccaaattatttttagatatatatgaatatttgtgtatgatttgcgaacaatggaagaagtattgattttagataaaaatcacttctgttttagatttttgttatttgtagtgacaccagtgtgtgtgtgacaccaacacacacatacatacatacaacataattagatatatgtacacctaattagctcccttgtttttactttttttaaaattccttggaaatgcctactttttacaggggaggcacaaatatggaagttctgtatggaggcacagatttagctctaaagtatgtggaatggtaaattgaaaggattttggaattaaacatttattgaatcatctccaaagtagtataagatatttgtatacagaaaatgctgtgagagaatttgaagcaaaattttctattatccctaattgctctttgtaatatattttaaatattgatattaaatatttatttttaattagtgtgtatttaaaactatagttaaggtaggaaattatgatttagtgtattttaaatatgtatttttattcctttcctcagccttctgttaaaatgagttgcataatgcttacattttacataggaatgcaaacagtcctattttaagtctggtcagaatttttaaaggattaaattcaggtatttaaaaaaatcattacgtcattatataaagacaagtctagaaaaatcagatagattcacaggcctttttacttactcagtctcatgacttttctcaggggtttattttattttattttattttttgggactgagtctcactctatcacccaggctggagtgcagtggctcaatctcggctcacggtaacctctgcctcctgggttcaagtgattctcttgcctcagcctcccgagtagctgggactacaggtgtacaccaccatgtctggctaaattttgtatttttagtagagacaggacttcaccatgttgtccactagtctcgaactcttaatctcaagtgatctgcccacctcgctctcccaaagtgctgggattacaggtgtgagccaccaccacgcccggccaggggtttattaacatatatacatacaccatgagaacactatattttgtatctcacattcttgcatgatcatatttaagacaacaggatttgttcaacattcctagacacctagtatgtcaaggaatgtttctacataagtattatttattgaaataagctgcatttagactatgctactcaccatataaaggttgactatgcctaatccaaacatctgaaatctgcaatactccaaacctaaaatgaaatactcattagaatatttctgatttgggaattttgggttagtgatgctcaactggtgggtataaagcaaatattccagaatccaaaaaaatctgacatctgaagcagttctggtcccaagcatttctaacagggatacccacactggactcgggtggtaatctgcagcagctagtgaggtagcattcctgccaaacaatttgagatacattttgaagtatttggaaataggtgtcatattctccctttcctgagtttctagtaattataagcttttcacttcaatagttactcatgtataatcagtgagtttaagaaaattccagatatggtaattagatactaacacaatatggtgaaaaataggaactaatatacaaacttgcagattctttatatatttaatacagatggaagtccttgtttaaattttaatagtatgatacattaggagaaaaggacatatttggtaaatctatatcatatatagtgtcagattttacaggataacttgtaaggaagggatttatgagaaaaaaaatgttagcggggccaaacaatgtaaataaatacatgttggcaaatgtgctcaggagtattttgtaaggaaggagttataaacattgcctttaccttttgattgtatttgcaaaacaatgattcttaatggaaactaaaatttaaagtgttgagccatgagtgctcaactttcattgcatactctgtcataaagcatgctggaaagaaacaaaaacaagcctactagttgatcagttatttattgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttatggccaagtctttgccttataggattatataatctaatgatttagagaacttttgttatctagagtttaaggtactcataaaatgctgtttggttatagaatgaattttctcttgataaatgactgtactcaaaggcatattgatttccatataattatatagctagttatactctattttattagcaaaacagtcttgaattttgcataatttaatgaatataattaatgactaactattcttccttcctctgataggctaagtaatcaggctgacctagcccgattcattatactcattacagaatagaaaaaagaaaagctgcaaaatagtattttgcatgatggctctatttttctcagtttccaatcttagggacttgactaatttcattttaaagcagtacaggtatatatatatatatatatatatatatatatattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggcaggtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgtaatttaaaattttctagaagccacatttaaaaagtaaaaagaaacaggtgaaattcattttaataatttattttatgtaatccaatatatttagtacattatcattttaatgtgtgatcaatataaaattaatgagatatatctttttattaactctccataatatgatgtgtattttacatttatagcacattttaattccaactagccacatttcaagtgattggttgccacatgtgactaatgacttccatattggacagtgcagatctagagtctcgatttatttcccatccctgtatccctgatgatatggcacactgtgaatagtgctattggcttatcaagtggtgcatacttccctagtaagggattattggaaaatccaggtgagaggagctgtcttctgtagttttggagagtaaatgcattcaatatgatcctgatcagcccataacctggggtaggggagcttacattctccactgggaatcactgatcttatttgacctctttatattctgcaagaggaaatgaggcccaccttcattccagggtccatgttctgcaataagcttggccctcttacatttctttctctcttgaagtagccttttcctgtgttgtttgttcattttgggatttttttttattattatttttgagacggagtctggctctgtcgcccaggctggggtgcagtggcgtgatctcggctcactgcaagctctgcctcctgggttcacgccattctcctgcctcagcctcctgagtagctgggactacagacgcccaccaccatgcccagctaatttttttttttgtatttttagtagagacggggtttcgctgtgttagccaggatggtctcgatctcctgaccttgtgatctgcccgcctcggcctcccaaagtgctgggattacaggcgtgagccaccgtgcccggcccattttgagatgttaatcagtttcccttctcttctagttttggatatctaatggaagattatcacatatcatgaatgatagttctgttgatgctatttctcttattaaatgttcattgccattatcttctttaaatctctaccatttaagtcacactgttgaagactcaactaatcagaaccaattgccttgcattttgaatgtgaactgcccatgaattctctggattgaaaaatattctccctcccctctattgattagtaatgtgttttttgttccttttcaacatatattctaaacgtttatagagtcctcttcactttcatgcttatgttatcctcttattaaataaagtaatgccaagcccatcatgtgagtgtttcttgggaattgagaaatttagaattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttccttttgttctgctacccattccccactaaccagaacacccagcactctagcctgattgttattcataatttcccaatgcactgtaaactttctgtcatgcgtgtccctgtgaagagaccaccaaacagactttgtgtgagcaataaagctttttaatcacctaggtgcaggcgggctgaatccgaaaagagagtcagctaaaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagcataaattgagtggcataatttatgaaatcctcaccctatgtggtaggttaccagagatttgtaaatagaggctctaagaggttaaatcatttgcttaaattacaaagtaaataagtggcggaatagcatccaaatatacatttttctgacttccccaatgcacatactctttcagatatgctaaaatgtaatttcaatattttctctgtaatatttgatactccattaatttcattaacaagcatatttcataagtagtacaaagatgaatttcaaaatagctctagcaataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaagtatttagaaagtcttattgatgaggtaccatttccatattcaaaagacagggatctgttaaccttttagtgaatgagacaattcataatttttccttgtttctgtctctgttaatcctaacacacaattactctatgtagggaagcaggaaactccatttacaatgattatttggggttaatttcatttaatggcattcttgacaaagatatgaatatggcaagaatatttttatattttacgtttaacctttgtaatttaatctttctaatttcatttgatataaagcgtaaatgaaagcaaaaacaccatttatagttgagtgtgaatttttttctttttttgaaaccagtctcactctgttactcaggctggagtgcagtggcatgatcttggctcactgcaacctccgactcctgggttcaagcgattcacctgcctcaacctcctgagtagctgggattacaggcacatgccaccacgcccagttaatttttgtattttttatttattttttattttttagcagagacagggttttaccatattggtcaggctggtctcgaactcctgacctcaggtgatccacccgtctcggcctcccaaccaaagtgttgggattacaggtgtgagcagctgcctccggccgagcaatacatttctttgtgtctctgcattagcgttatacttttttttttttttttatattgagagggagtttcgctcttgttgcccaggctggagtgcaatggtgcaatcttggctcactgcaacctccgccttctgggttcaaacaattctcctgcctcagcctccggagcaactgggattacaggcatgtaccaccacgcccggctaattttgtatttttagcagagacggggtttcaccgtgttagccaggctggtctcaaactcctgacctcaggtgatccgcccccacttggcctcccaaagtgctgggattataggcatgagccactgctcctggcctagtgttatactttaaatatttttatttgaatacctataattatgaaacctgcaatattaagcatagttaaactttcaaataaagcaaatgtataaatatatccaattctattcatattcacttagtccactttctcatttcacacatttaacaaagcaagcaatgataaaatatgcatgtcttgagtattataatttgcatttgaaactgcagaatcttctggctgaatgaatcaataatgcaaatatctttctaattagatatttagtgttttttagttgtattttgtaaaatctaaagttttgtgtacaaaatagtttttttttttttttttaaagaaatctgacagatcttttggtcctgtgtttcaaagtacattgtgaattttgactgaaatcacagttgtctttggtataccaaaattaagttctgcatagtacctattttagtgttacagtcagtgtaactgctggaatattcaggtctagtggaatcagtaattatgtaagcctttcttgttagaggatttcttggcttagatacatcccttatatgtgcattgccccttattgccttattgtcattctaattactaccactcctttgtccccatccccaccccatggccttcattctttgttgctatctttgtgagtagaaagacaaactataaggaaaacttgtatgtgagctgtgtggggggagcgggtgagttacagttatttctaatatctaaagagttgtgtagaagaattagacttgcttgatgaaggcacaaaaggaataagtagaaccaaggaataagttgctgtgataaaggcatgaaataattgataacccaagatgcctcgatttggacctgctgccttaagagatactgagttgaatgttaaggcagtgaagtgcaatggaaggaatctgtgagcttggaaccaggcagacctgtatttcaattttgggtctacttcttaaataatagctgtgtggtcatgagcaagtcactaagtgacagaaccttggtttctttatttctaaactgggagatgatgcttaccttgcaggttgttgtaaaaactaagacatgatgtgagtaaagccccttggcacagtgcctgtcatgtaataggtctgtctattattgttgttttattcattttttgagtgatcaaaggttgctctttaaaaaaaaaaaacaactctaggtttagtggtacatgtgcaagtttgttatataggtaaattgcatgttgagggatctggtatacagattattttgccacccaggtaataagcagaggacctgataggtagtttttgatcctcaccctcctcctacctgccaacctcaagtaggcccccttgtctgttgttcccttccttgtgtcaaagaccactctttagaaatgatgttgaaagattgtacaaggtagtgaactaatataatttgtattatcccgtttatcttgttgatatgattctatattacttttaaagatatatggttgactggtaatgagcattatccccttctcttgttattggtatactgactaggttagtaattcatttttatttttatctttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataatgggtttctgattttatgtaatgtacttctcagcccttttatttatttttttatatagctttgattctttgaagctggtatgtgaagcacaagctttatttatttacttatttagagacagagtctcgctctgttgcccaggctggagtgcaatggccggatcttggcttactgcaacctccgcctcccaggttcaggcaattctcctgtctcagcctcccaagtagctgggattacaggcatgtgccaccacgcccggataatttttatatttttagtagagatggggtttcgccacgttgaccaggctgatcttgaactcttgacctcaggtgatccacccagcttggcttcccaaagtgctgggattacaggcttgaggcaatgtgcctggccgagcattattttcaaagtgtgctcaactggagtgcttctttctcctaggatgcccactatttgtgtagggccaatacttaatgattgttttttcatgattgctattaaagatactatttttgttacccaccctgatgctcgtgcttcacataacagcttcaaagaatcagcgagcatttggaaatgtataaaatgactcctgtcttttgtcaggagtagaatatactgataaaatcctttctcatgaatgatgaagttgccagaaatttggaatacttttggactgacaacaattacatgataaaatattgtgaaaactatttgtgaataaataatgaaccaatactacttctgttcactcagaacaaacataatacagtggttcagaagagcgtagtaaccttcatattgcttaatagttcagtaaacttttaatgcctctgaaaatgcataatagttccttaagaaagcatggtaggataatcagaaaagactttttttttttaatttgacaccaaagggattcatatatgacatctgttcattttttccacttcccttcttctagtaaaatacctagaaataattattcctagagaccatgtgatatttccacctttagtgtctagcctgcaattatttcaacaaagtcctcttggtacagtaaatagtaaaccccactggaccaaatcctaatagtatagtattggctgccatagtgtaacacacatggtatgtttacattaaattggtctcatgtcttaaaaagcatttgtctttatatttagtatagatacaatctagagatagattaactggctagatgatgatgataataataatagctaatctttattgagcacttactatgtggcaaacattgttctaagtgtcttatgtgtcttaattcacttgttataacatcccaaatgaagtacgtagtgtttttattccactttatagagacctaaactgaggcacagggatttaagcaactttcccaagattacacagctagttaagtggatgtaatccaggtaatttgattcaagggtccattctcataaccattatgtgatactgcttcatagccattgtgtgagactttaagagatgctgcagtgctttctcctttttcactacttcactatttctcgttcatagccctttgttcacagggaaaacataggaagggaaaaactagaagctccttgagtttcacctgtttattccagatttttatctcgtggtgtctcccattgtataaactgagatcagtaagaactgttattatgccatatgtttctaatcatagcaattgcttcattctctgaggcatacaacacatgaaattattgtcagacatactgattttatacgtttacaaatgctcgtttaaatagccattgaaatacaaacttcagtaaagagagtaatgtttggtttgcatgatgtctgaattctaagatttggcaatggagtaaagattttgcctagatcttatctttttccccccattctacagtgaggtacaatgataattgttatcatagtgatgaccctgggagagcattaacatcttttgttccctagaatgtacttattgaagcaggaatgtggatgattatgtttatgtttgattttgtttgtttttgagacagggtcttgccctgtcacccaggctggagtacagtggtaccatctgggcgcactgcaacctctgcctcccaggtttaagcaatcctgacacctcagcttctggagtagctgggactacaggcgcatgccaccatgccaggctaattttttgtatttttggtagagacggggttgcgtcacgttgcccaggctggtcttgaactcctgaactcaagtgatctgcccgccttggccccccaaagtgctgggattacaggcgtgagccaccttgcctggccggttgcttatgttttagatgtacagttgtccttaggtgtctgtggggaattggttccagaaccacccccccttgccaaatcccttatataacatggtatagtatttgcatataacctgtgcacatcttcttgtatactttgaattatttctagattacttataataccaaatacaatgtaagtgctatgtgattagcagctatactgtattgtctagggaataatgacaaggaaaagagtctgtatatgttcggtacagacaatcatccatttgtttaaaaaatatttttgatctgcaactggctgaatccatggatgaggaacccacagccgcagagggctgactgtatttttactgacaaaagtttaaacataaaagcaataaccaaaaaaggtagtttagtcacaaaaagtttaaagtgaaaattaaattaactacaacatactgtaattcatgccaaacagttgttcctcctaatcaatatttgaattttgaaagagaagtaattgtatatatattgtaagaattccactgtagatgagtcacagagcagattgatgatcgtatttttttgctatggtagttaaaactttttattcagatttttatttagtgctaaatgagttcaaaatgtatattacctctctggaaaagctcttatgttagactgtcagctatctagtccattttatattttcaacttgaaaaatgtttaaaatgttaatttatttcaattaaaatttaacaggttgaaataaaatgaacatcagatttctcttttgattcactccaattcagaaaaacaacttttgaaatcttacaatgtggtaggcactgaacgtttcaaagactgttaggaaatggttcctgtgttttcaagctttttccagtggccagttggtcacatttatcaaatgtactaaaactatgtttttagacatactctttaatatattcatgtgaagtttacagaattatgtttgaacacaatcctttttgtaggtgttcacagtttctatgaggttttacttcactggttttcatgttatcttcataatagcattttaatgaatatttatttctacccaactccttactattacagctggagggagctgtgctacaaagagagcactctctgttgagagaaacttggaaagttgagttaacatattggcctgggttgctaatcccaaagaacaggaagtcttagggctagagtgagggaggagattgggtggaaggggtatagtctgaagtctccaaagcttagagctctgacagcctacagttttattttgcccttccaatccatccaatgtgactcttttgacattcttaaaataattgagaaaaaatttctgatatagcttgtaaattctgctaattgatcctttagtaaattgaccatttggcaaatagtcttttctgcgactacatcaagagtccctgttgtcaaagaaatgccttagcaaatggaagatataaataatacctttaccaagttacaggtaaaaaggtgccctattaattaagtctgattttcaaaataacccactgaagagtacagggattattatccctaattaatatctgtatttaatactggaagattcagagaggctaagtgagttgccctcagttaaaagataatgaaaatggaggaatcaagatttgactcaggcattctggccagtaagtgtatttccattataccattctgaagataatcactttgtttaaataatttcatttttcacattttgagggctagagagatggggacgggagatgaaggagtactgaagtttgctcacttgatgacatgtttatgtatacttttcctgtacttaggaaatcaatttcacaagacattgttttaagaaattttaagcctgttattatagacatgaattaactacacactgttaatttagaaattattgttagagcagttattatttttgtacatgacagcattagaaaataatgaagttctaatattttgatttttatagctcacatccctattctgggtctcctttccaagttttcaaacttagcaggaccacagaatttcttgttttagactgctaattatcttaagacaaaaagggatcatcctaggttctgctggttctcacattaaagagaaatttccattttccattaatgtattcaaatacattcactttaaagatacctatactgtactgctaaagagattaccctctatgtcttattctctattttaggacttcagctttcagaaacagctgtaaaactttcttaagcattatgaatataatatttctcaactcatcttaaaacacttactatttactatttctcttattagatatggcttctgaaatggtttaattgcacttcaaaactatagcattttattgattttattttttgaaagctgctttatgttctgtagtgtttaatggaggataagttactagtcacatatgatactgtgcatacgctagatttaaatgtttagtgcttacttttgacaactacgtaaagaagatctatatactagttctggatttatttttgaaatggaaaattgtgcttttaaaattattatgggtagcttcagtttgtatcacagtataccagcaccaatacattactggtgtcatcttacgtgatgtatgaaaatttgaggtactagagtattggtaaaatgctatttacccctatattcttactcatttaaatccaaagctaagtctttctactggtactaaatattttacatcgcaatggaaaattttaataacgttgtacaaaaatatatagagaaactaacaaaaatccaaatgacctcattcatcttttaagcagttaaaggcagtggaataaagtgtgcaaaataatgacatgcaagatgaaaaccacctaaaccttattttcctttcctagcctagcttgttctattatgggttttatatgaacatactttgaaatgaaatccattagttgaaaaacaaaaataaaattcttaaccaagtggcaggcatatacaatagtccccccttatccacagggaatatgtttgaagaccctccagtggatgtctgaaaccatggatagtacctaaccctttatatactctctctctctttctctctctctgtagtgtatatatataaaaaaccaagactctctctctctctcatatatatatatatatatatatatatatatatatatatatatatccatctgatagccaaggcagctaccaaatgactaatgagcaagtagcctatacagtgtggatacactggacaaagagaggatttgtatgccaggtaaaagagtgtgggacagtgcaagatttcatcatgctactctgaatggtccacaatttaaaacacatgagttttttatttctgcaattttccatttaatatttttggaccatggttgattgcaggtaactaaagctgtggaagggtaaacaaaactatggataagtggggggctactgtaacataatctttggtttttaggtatatctcagatgtatctgaaataaacattgagatactgaatgaatattttatagcaaccatcttttctttaaatctaagcatccttcttaactctaaaattatgaatctaatttgtgttacattttatattgctaatttcttatttttttattttatattttatgttcagtccatctttccgttgcttggaatatttttctgaggtaattagaaatttatatcttctccttagatttttttctgaagtcttgttacagtgtgatggtttttcttcatttaattaattagagaaactatagtataactaaattcatgattgaacacattttatacaaattacaattgagagccgagggactatcttcagcattaaaaactcaaacattcctaactttactgtaatgcccttcaaattaggattgggtttatttagcatataagagcaagggctatgcagtacgtaaatacaatacgtactaaaaaaatgttttgttgcatattcatttatttattcatatatattattacaattttattgaattttgtacaaaccaatgcagcaataaaaaactatggcttagtctatatcctcatgaagatgaggatagactaagatataaatatagatatagatataaatataaatatagatataaatatagatataaaaccaatattcattttaatcatcctaagtgcttaaagaaaacatccaggagattagagggacctagtttgggaggacagggaaggcttccctgaggaagtgatatttaagctgaatctttaaacatgaataaggattagataagcaaagagaataggaaattttttttaatatggacaaattagagcttaatattttaaaaatatataaatctgagattggatattccgaactaacaattcaagttatttaaacattgtgagctttataacaacatggaaataacaatatatggcagttttagaaccttgctgaaaaataaccttggtaaatctaaattttatttaaaatgaagctgtgtggcacacattgattcaaactgtctgtaaatggagtattgagaaggaatatgacagccagcaaatgtcaatggcgactttgattaagaacagaatgttgaaaaacaaatacctaacaaaaactaatcaattaaagtgtgtgtggagtggagggaggaatagctcaaaacacgaaagatgtttataaggagccactatgatatctaattctccatgccatttaataagcagactagccatgactgtgtacctgacctgttgaccccaataactcattattcaagtgtttactagataattttcatccaacagcaaatttcactgtgcctattctaggtaactgtatgctggggccctctgggtgataaaaggtgttttattagctgcttccagacaccccagttctcacaaggttaaataaattgtatgcctgctaaatgagttagcaggagatttaaaaatagaattcaaggttttttttttttttttcctttgtgctttcttactgtggttacactatctttaaagtttgtgttggtttttcagcagcacaggtctagattagttgcatttgtatacttccaaagagttgcatatttatttgtcctaatatatatatttaaaaaaaaagttgttcagagataaagggtaaacacaataagcttactgatcattcaaaactgcctgtacctactcatttgctctttcagcaagtgtttattgagtatctgtggtgtgtggtgttgaagggttatccttaggaaacccaagaaaaaaaaatgtggtcttggccgggcgcaatggctcatccctgtaatcccagcacttggggaggccgaggtgggcggatcacttgaggtcaggagtttgaaaccagcctggccaacatggtgaaaccctgtctctactaaaaatacaaaaaaattagctggacgtgttggctggcacctgtaatcccagctactcgggaggctgaggcaagagaatcgcttgaacccgagagtcagaggttgcagtgagccgagatcgatccactacacttcaggctgggagacagagtgagactgcatcttaaaaaaaaagaaaagtggtgtttgcacttgaggagtttttgatattactaatgttatgaaaggtctgcatattctcacaagacatgaagctgaaaacgtaaaatatccttctgaattctggggttttttgttttaaattagggagatttggaaaatacctgctatagtatttcatttctgctgtgttctatgtgaatataatgtgaatgctcactgaatgtatatgctataccactggttgaaacttctgcaagtttattttcacttttgaaggtgtatattatttccatttttacaggaaagagggagtaaatacactcaggactaatagttgcttatttacaaaaatgttcagaaattacaagtcattactttaataaaaagtttatcatagtactgagtgtttcaaaatattatttctagagatattgtttattttcagagaaacaatctgttgaaatgtagatttctaaagtattttctgcatttgatatcaagtgtccatagaaaaacgcagtatcctttaggggtaccaagctaactaataagtgtgtttcacatacatttcgaaagttatgttgcttttattataagttggaattttcttcccattggaataacgagcgttttctttaaaaaggctgttaaagagaaaaaaacactgacccaggagtagcccaaacacctggattgtgatgctttcagcgatatagctgcatgaatttcaacagcacagtcacctagcatgaatcttgttttctttgttgttatctgccctgcatgtcacacatggttgttacgaggatcaaatgacataatatatgtgcaaatgcttgtaagttacaacttgttgtataatgtaaggtacacctattttctgaaagctaagctataagtattttttatccagtagagggagtcaaccatttgcatgttataaaaaccagatctaaatttcttctcctcttaaaataatttattcttaaatcaaagtaaatatttggagtaaagtatatgtgtgtgagaattcatttttattgatagaacagtgataaaatatttgatgaatacatgggtatttaataatatattacatatattgacaaaactcatttgattcccttgaagtacacttttttaattttgtattccagggtactaggtaaaatcattcatggtggtcattggttgtttatgctagatattggactatttcagccttgatgtctactgtgaacactgatgtagtggccagtggtgacaataaagtaaattgacaaccatgagtcagaattttagaacttggttgaaccttccatgtggcatggctgtagatgaaatgaaggctcaaacagatgtggtgaaatggcattttatctggcctattgacaatatccaaggagtctgctctggtcatgagaatgcagctgcatgttctttcaggcagacctttggcagaattgtggttccaggagatcagtctggtttggagcaaaaattcttgccaagctttgggattcaccatgcaggatgctatattcaattcctagagggaaaggttagcataatgccaagttagctagtgttcaagtcaggttcctggcccagcaagggacgtttaccctaagtacctgggactcaagacttaggacaggaaagataaatctagatgtgacttacaggcaatactgtggatcctaactattttgagttcccttgtcataattgagcctgcagacagtaggtgtcattgcctggaagcagccatttgtgaggctggaggaacatactaagaaacacacagctgaaatgtgacagatatgtccgcttctctctgcttcttttaactgatgtgggaatttgattgatacaaccaagaaaaacttgttatttttgatacctctgaagacaatccctgtattagaaatttaaaagcctggagtcacatgtatttgtgtctcatgttccaattgaaggtttgaattttgaaagagtttaggaggaagataagtcaatggttgactatgtacctaaatttattaaaattttaaattaaatatttagtaaagtgatgtgttatcaataccatttccttataacaatagtagccagtttgagaacatgatgaaaaaggtcacattcataatagtaaacaagtataagctgattttaataagcttaataggagggtatataacctacataaatctacagcactttgagagctatagaaagcgactagaataaatacgaagacagtgcaattctagatggataaaggccataaatatataaaatttctcttgtaaatttatacatctaacataattataaataaaaacaggaattttagttgactttattgaatttagcaagattattatacagatggaagaggaaactggcaagaatgtaaaatgccattttgagaaccatgggcaatattttggtgatgggggactaatcctataaaaagatgaaggattcacatttttaaaaaagggagatattataatagcacacacattcatgtaaataagtgggaatagaaagaaagttcaataatagattcttatttatttatttatttatttatttatttatttatttatttattttttgagagggagtctcactgtgttgcccaggctggagtgcagtggtgcagtcttggctcactgcaagctccgcctcccaggttcatgccattctcttgcctcagcctcctgcatagctgggaccacaggcgcccaccaccacgcccggctaattttttgtagttctagtagagacggggtttcaccgtgttaggcaggatggtctcgatctcctgaccttgtgatccgcccgcctcggcctcccaaagtgttgggattacaggcgtgagccaccatgcccgccctagattatgtttttgcatatgtatattataaatatgaactatgttttctgtaaggatagaaaataatggggaggaaatatacattccaataccattcattaagtaatctgcctgtaaatctggctccataactcatattgtgtaccaaaatcatagacagattaaaagtaaacattgaagtgaaaatattgtaagctttgaattaattgaagttacaaaaggacagatttacaactttgaataaataaaagctaaactgtatagaatgctgtaaaatataaaacactcagaaaaatacctgcaagtttattacacacgggattaatattgttagtatccatgcactgcatagaatgtgatggaagcatctaggtttggatagataaatgtgcaaaaaaatagacaatacgtatgagtggaaataaaattagtaaaatgggaaaaactttaacataccaattgagaaatgcaaaatttgaaaatgaggtatcattttccatcttttcaattggaaatcttaaaatggcattgcctaataccatgaaatttgtgcattactgtattatgctggtagcattaaatctgtttgaaaagaatttgacggaatataccaatccttgtatctattgacccctgtgatttagtattttggacaatttaccctaaggaaattatccaaaagaagaaaaaagtatttatttgcaggattgtttatactaatggaaaattggggtgggcagaaaccttaattccaagagggcaatgcttaattatgagccatacactcaggagtattatcaggtagacactagaatgacttagatatgctgtgtagaaaatgaaaacattcctctgatacagtggttaaaagaaattacacgtgtcatatgatgtatgctttcagttatgtacaatgtaattatataatcgtatgttagatgacaatgtgaaaactaagcttctagtctggtgggatttttaatgacttataaaaaattctccccggactttatggggtaaaaggaaaatgagaatggcagagatttttaaggttttaatgttatgaatgctaaagtattctgctaagtaaaaatgataataacttttattgatcatgttctatggaccaggaaccatagagtgttctgcatttattctttcgttctgaaatgcttgaaaactgaaaaggaggtttaggcaggatatacttgtctccataagatagaagggctgtgataggatggaacaatttgaatagtcctttttcattccattggaggttaaaaaaatctattatcagtaaagtaaaaattataaggaaacagatcttaatgctaacaaaacaaaacaaaacagcaacatacgtgtccctttctttgctttctccacctcaggaaattgacattgccgtacttccagatgtctaaactagaaacttgtgtttcatacttgattccttgcacttcctcattctctacttccaatctgtgaccacattctatctattctaactgctaaaatatttctgaaactcatctgctccttcccattacccctgtcacctttttagtttaggccaccatcctcatcaccttgattacaatagcagtctcctaactggtctctttccttccatccttaccccctttcttctattcgctacacaaatctaaacatgtcactcaccagcttacaaaaatcctcagtgatttcacttcgctggattaagtccaaaccccttaatggggctttcaaggtcttcatgacttatatttacttcaccagcatctgctccccagcaaataaattcattctccctttcctgctccttgtccctttccccaccccatctctctcagtcacacacatgcaaatgtacacacaaatacatgtacacccctacagccataccgaacttcttccatttccatgactctgtttcattctctctcatcactgaatcttccacggtgctgtgccctccacctggaacactctccgttacttgtccaacctcgcctgagctttctcttatgatctcttgttcttgcttatccttcagttttcatattagacattccttctcctacaaaggctttttggacatctgggttgcatcctcctatgtgctaccctaataccccattccataccctttatacttacattactgaaaaataaggaccacctgagtagcattgtacctttggtttactaccatatccgtagagttagcagagtgtctggcacatagtagatgcgtgctaagtattcattgaatgaatttgtatggtttgggcctgtgttgtcaactacttaagatttatatttttaacttcaaatttgagcactgtcttcttggtcatcatattattaacaacaagcacaatgccaaacacggtacattttcagtaatgattggaaatgaatgagtaactcagtaagtatttgaatgaatgatcattgtaatggtgacacctcactgagattaatgagcattcatcctttctttaagttccctgaagggaacttcatttgtctctgttttacctaacatagtgtcttacatgtagtagacactcattggataattaccttcaattcccaagactgaccactatgtacagagttccagctagtgctggcgttaattaggtgatcttgaccatatctggaatttgaacttgagctggatttctctgtatatttgtgtatgtgtgcctgtatgcatggtcatgtcaacatatattttttaaagacatagactggttttgtattatgtatacagtgaccattaaaacaatgccatcacactacaaccagtcagagttctcttcttgttgttggttgttcatttgttttactgtggttgtttttgccttggactttgagagaatcctggactgtaaacttttaaggcaaggtttaagtcttgtcctaatcattcactgtgtagtcaacaagaaggtgttaggacttgagaaaaaaaattacctgaaggaaatatatatgagaaacgctttatggggaaatttttttgtcttttctgcttgactgtagaacttcaggtgttgtgtaatacgtattctttcacctccacttccctctgtaaatgtgctttactcataaatgtctgtctataaagatgtgtcctgggtctttaacaagtaggaggtggtacatacttgaataaacatcctctaagtggttgaggttgaaaaggtgcaaatctttcctagttgaagtaggagaggctgtacctgctttgttatgagtcctttctttgtgttctcattattcctttttttttttttttttggttctacatttttttcctgtactattttgtacagctcctttcttatttttttctttcacctctcaactctttcattatcactcttttttcatttattgaaaccatatatccatgttttttgagtgactttgaccagaacagttggttcagctttctttttaaaataatatttaatgtatttcaattataaaagtaacaatctttaatttagaaaatctgaaaacaaaggaaattttaaagaagagagtatgtatctaaaatcctcttacttaggtataattatcattaacattgctataaattactatttagattttttacctaattgaaatcattctgtacctagagttttttttacctaattgaattttttacctagttgaaatcattttttacctaattgaaacattaggtaaacatttttacctaattcaaataattctgtacctagagttttgtatctcattttaaataatattgagtcaaagatgtatttccacatcattaaaatactttaataggccagacacagtggctcatgcctgtaatcccagcactttgggaggccaaggcgggcagactacttgagcccagaagttcgagatcagcctgggcaacatggggaaagcctgtctctcttaaaaatacaaaaaattagccgagcatggtggtgcgcacctattgttttagctactccggatggggaggtgggaggatcgcttgagcccaggaggtcaatgctgcagtgatatgtgatcacgccattgcactccagcctgggagacagagtgagaccctgtctcaaaacaatttttaatggctgcataatattccattttaaatagataaagcttacctctttatttcccgatatttgcactgttcaatgtatttacaagtttctctgatataaaaatgatgtcatgaataacttagaacgtgaagtcctagctacagttcagattgtttcctgtgaaagattcctagaagtagcattatcaggtcaaaaataagtcatactttttgaggcactttttttttttttttttttaaccacatggctttccagaaatgttatgccaaatctgctcattgctatcagcattgtaaaagaatatccatcttaccccatgggtagggctttttagtttctttaacggtattgtagtttctttaacagaatattaacagaatactgttaaaaatggataaaaatggataactgtgtgaactgttatcaaattaattaaacaaagaatattatttggcatacatatttgaatcttgttctgaaggcagtgggtacatggtgtgttttcttacaattggaatgtcttgtgtgtgtgtgctgggttgttattctctgaaattgcattactgtgttaaatccccaaactaaagcagtgaatttttttgtaagttctgtatctttgtggccttgacaactgagccagtcctttggagaataagcaatcctggactgcattttaggacaatgagaactgccaaagtcatgagagagaaagacgaatggataggacactgaagtagaaatcagatgccctaggctttattcccacatccatttgtcattgtgtatcatggccaaatttgattaaagaactttcccaatctgtaaaacggggataatatgtctcaccttacagggatggtaaagggattactgaaatatttttttctaattcattttgtgttcttccaaaagagctctaatattcagaaccaaatactgaaatctatccaaaatctgaatggtagaaattaactattatactttcaagcattttaaaccccagtttattaagaacctaaccccttagtgaagagggacagatagtcaacagaagaataaacaaagaaaataccaaatagtaatgagcctccaaaagactaaaacattgagtgttcttttttgttaagatgccattttaacccatttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttattatattccttgactaagtggatctgcataacaatattaatacttgcctgcaacatgccccaatttttaaaataacctaaggaatattcaggttttttgtttttgcaagatttcttatttttcccaaagacatatttcatatagcagtcttttcctttgagagtgttttgcccttaattgtactagttggaagtgtcagaatagtgcattaacctactgagctccagatggctgacttttttttgttattttatcttgtcttgtttaaaggaatatagaattggcagcagagcccactaactgatgtcagatttggttagcataaattgtatgtttaatatcaagtaaacatgcacttaaaaatcatatgagttgtactttttattctttgctgtacaaaatcttcactgaatatatttgataagttgaaaggctcattcattttgtgagaaagtttatgagattactgattatattacttattgaaaatatttagtatctatatcctactttgggtgtagaaaaaagaaatgaagccttttggaggtatgtgtgtgcatgtctgttgaattgttagattatactaattttttctctgagaagtaaatgacatgctagaatagtaaattgtataatgtggaccatgaaaaagtattatttctaaaataattgttttgaggaaacagaaatgtgtgtttccttatattcaaattcacaacttaggtccttagaggtaagaatgctaccagcagaaacagatggttggtaatctgtaaaagtaatgccatcatattgggtaatgccatactgctgtttctattggcataacctctaactatgacatgatatatagcacttatgggccagaacattgtttgtacttttataaaaaccctacaaagtctatacgctcaagtactagctcagtattcttatcaggttgggtttttgttttgttttgttttgttttttttagacggagtcttgctctgttgcccaggctggagtgtagtggcatgatctcggctcactgcaacctccgccacccaggttcaagcgattctcctgcctcagcctcccaagtagctgggtttacaggcgcgtgccaccatgcccaacttattttttgtatttttagtagagacagggttttaccacgttggccaggctggtctcgagctcctgacctcaagtgatctgcccgcctcggcctcccaaagtgttgagattacaagcgtgagccaccgcacctggccagattgttctttcaagttaggataggactttggggtaagcagtatttcgtgatattcactgtataccattttagaactgaaattggttcatgcagcaaagatgaattatttatcacaaaaggcttgaataacctatacatgcatcactgctatagaaaataaacacatatgtttgagtttgttaggtaaaattagtttattgaaatgaaatcccccaaaatcaactttcatatattttttgaatttatatatactaatataaacaagtcattcctcttttaaatattaaccagaggagtatcccactaagatactatttgatttcaaatatgtcagtgttaactttaaatattttaattatactgtttaactacgtggcaacatagggtacacactatagcagcatctcttatacaacttatcaaatatacatgttaaatacaaaacccataaaatttaaattaacattattttaagtaataaatcatttgctgactctaaattgccaattacaatgtgaatatactacagtgcgggcacttttgggttctctgtgcctaccgtgccgtaggataacccaactgtgccactagtgttctctgatctatggttaaattttgattggtatagcatgctgcgatgtcatttggtctttattttggtacatatgtgttttcacactaaggccatctcattagccagaggtaatgaaagttgtacttcctggtaacagtgtgaatatatggatgctgagactaattggcaggacttggttataaggtagttatctagatgatccagcttatgcctagctttatcatattaagaaatgaaacttcagaattttaacattaccttaccagactcagggatgattaaaactatgttcaaggatcccagtttgagtaccattgctgtgagctccaggtatattgatctaacaaatccccgaacatagcatgttgtattatgacccaatatttattgtaatttctaactgaaatagccttatctacctttggtgaacagtttttacagctgggcagaccttcttcccccgcatagagtcaagtcctttaaccttcaaactcccttatcaccccctatctattttgaaggcacatatcacattgacagtggtctgcatgttgttgcttaccatacctgaataagctctgctgggatggtgaggatatatcatcgcttatctctgtactctcagtgcctggaacctcatgggaactcaattcatgctgactggtaatattctaatacaaaaatgataccatatgcacagtaagagatagatgccttgtgtctctgtagtctattttgtgaagaaaccgagaatctgtataatcaatgtgtgtgcagagaatatagtgaatgtgtgtgcagagaatatagtgtccaattaaaattttatgctttaaagaagaaaagcttttgctttagtatgcatatagtggcatattccaaatcatagattcaacagggcaggacctttgggatcatctagctcagtgggtttaaaaccttattttatttaacataagagcagcttattcataaaaaatcatatgtgggatatgaataaattagaagataaatgtgtaaatgccctcatttttgggggagcagagacttgggaagtctccccaggagccttccttttttgcacattccctactcaccctccaaggcaacctggaaaacacctcaaggaattccatggacccctgtgaaaataatagtcttctcaggccggacgtggtagctcatgcctgtaatcccagcactttgggaggccgaggtgggtggatcacaaggtcaggagttcgagaccagcctggccaatatggtgaaaccccgactctactaaaaatacaaaaattagctgggcgtggtggcgcacgcctggagtcccagctgctcaggaggctgaggcaggagaatcacttgaacccaggaggcgcaggttgcagtgagccgagattccgccactgcactccatctcaaaaatactgctactactaccactactactactactactactactactactactactaatactagtctcctacctaaggtaagaatccttttccagcatctcagacctagtggcaggtctttgcttgaataatttaggtgaacagaaactaataacttcataacatgagcagtcaactaggcaattgttaacgaaagtactcactaaattaatgataaaataatgtataatggcaccaaacattagttaagtgcttattatataccagaccttatgtttgaccaggatccttatttcacccttatgacaagcctgaggagggtagatgctttattgttcccattttgccaataaggaacctcaggcccaggaagtcaagtaatcacttgactaaattcatacagctattaaggtaaggaatatttcagaaacttttgcctgcttttccctttttgttataatcctcctttggaagcaaattatgcccctttttaagatggttttgtactgtcctcagagggcgactctatagcctgggttctagccttgcttctgacagttagatatagtctcagacaagacatgacttctccgtgactcagttttcacagcagaagaaaaaatggttttagtaatattttccctgttgttagattcagatgaaatagtatgcaggaaaagttgtgaaagctgtttttgctatagaagtttaaggtatcctttatttatttattttttttcttgagacagagtctcgctctgtcacccaggctagagtgcagtggcgtgatcttggctcactgcaagctccacctccggggttcacgccattctcctgcctcagcctcccgagtagctgggactacagacgcccatcaccatgcccagctaattttttgtatttttttttttttttttttaagtagagatggggtttcaccatattggtcaggatggtctcgatctcccgacctcgtgatccgcccgcctcggcctcccaaagtgctgggattacaggcaatcccattcagtgctggaggcacacatccatttattcatgtgacaattagttacatttctttttatttttccttgttttcctatcctttggccattttactattgatgcactacctcccatcagcaggtagacaaggaactgataaaattcagtgtgttcattttgtctgatagcacttactaaaatgtttagaaggctagcgttttgaaaataatagggtaattttttgttttgtggaaggaatatttctttatttcatttacaatgtatagcttcattacctacttaaaatgcagtttatatctaggctgtaggatacatttataatctgcaaaagtattattaaacttgctttgttacactgtctaaagttactcttggaatcggatttacaaaatggtaaagcagagagggaaaccattttatttaaataccttcataatctttgccccaacacaacaaatgttggtaagtcttactgttgttcctatctttaaacagtacaatgaagagattgcctatgcgaaatacattggttatcctattgcacattatcattgatcaaatcctgcccattttttaaagtcactatttacatacatgaactttctttatttaaaatggtagtgggccgggcgcagtggctcatgcctgtaatcccagcactttgggaggccgaggcgggaggatcatgaggtcaggagatcaagaccatcctggctaacacggtgaaaccccgtctctaccaaaaatacaaaaaaaattagccaggcgtggtggcgggtgcctgtagtcccagttactcgggaggctgaggcaggagaatggtgtgaacctggtaggcggagattgcagtgagccgagatcgcgccaccgtactccagcctgggcgacagagcgagactccgtctcaaaaaaaaaaaaaaaaaaaaaaaaaggtagtgtactttttcttctgtcctaggacagtgggtggagtaaatgcagtgtaattccaaaatagaggtaacaggctactagaagggttcttactcattttgtgccatgggcccctctgaaagttggtgaatttatggggacctttttagaatcatatttttagatgtaaaacacaaaagacataggattataaaggaaaccaatcatattaaaatgtacttataaaattgtttttaaaaattatgacacattccagagacataaacacatatgttcacacaaaaacctgtgcatggatgttcatagttttattcatagtagacaaaaactggaaacagcctaaatgttctttaacgggtgagtggttaaataagctgtattatccatactatgggatactgtatggcaataaacaggtataaactattgatatacacaataacttgtgtgccttcccagggcattatggtgaatggaagaagtccatgtgccaaaaagttacatatagtatgatttcatgtaaatgacattcctttttttatgggtacatagtaggtgtatatacttaaggggtacgtgagatgttttgatacaggcatacaatgcataataatcacatcagggtaaatggtacaatctttaattgtacaataaattattgttgactatagtcaccctgttgtgctatcaaatgccagatcttacccattctgttaaactatacttttgtacccattaactatccccatttcccctccccacccacttcccagcctctggcaagtatcattctactctcttatctccatgagttcaattgttttaaatttttgctcccacaaatgagaacatgagatgtttgtctttctttgcctggcttatttcacttaacctaatgtccttcagttctatccacgttgttgcaaatgacaggatctcattcttttttatggcggaatagtacaccattgtgtatatgtgccacattttctttttcttttttttttttttttgagatggagtcttgctctgtcactcaggctggagtgcagtggtgtgatctcggctcactgcaacctccacctccctgattaaagcaattcccctgcctcagcctcccgagtatctgggattacaggtgcacgccaccacgcccggctaatttttttgtatttttagtagaggcggggtttaaccacgttggccagactggtcttgagctcctgacctcaggcaatccacctgcctcggcctcccaaagtgctgggattacaagcatgagccaccacgcctggcccctgtgccacattttctttatccatttgtctgtagatggatacttaggttgcttccaaatcttggctattgtgaatactgctgcaataaatatgggagtgcagatatctctttgatatactgattctttctttttggcatatacccagcagtgggaatgctggaccaaatggtagctcaattgttagttttttgaggaagctccatactgttttccatagtggctatactagtttacattcccaccaacagtttatgagggttcccttttctccacatcctcgccagcatttgtcattgcctttcttttggatggatacaagccattttaactggggtgagatgatacctcattgtagttttgatttgcttttctccaacaatgcatgatgttgagcaccttttcatatacctgtttgtcctttgtatgtcttcttttgagacacgtctactgagatcttttgtccatttaaaaaaatcagattattagtttttttcctgttgagttgcttgagctccttaaatattttggttattaatctcttgtcagatgtatgtatagtttgcagatatgttttcctattctgttgtctctttgttgattgtttgctttgcagaagcttttgaacttgatgtgattccatttgtaaatgatacttttgaaaaaaaatgatagaagtggagaataggttagtggttgctggggtggagggttgtgggaaggagatgggtgtggttattgaaaggccaacttgggggatccttgtggtgatggaactgttccatatcttgattgtggtgttggtatacctgaatttacacatgataaaactgcatagaaatgcgtatatatatacacacacacacacacacacacacacacacacatataaaaatatatatacacatgtatatatacacacacacatatataacacacaaataagtacaaataaaactagggaaatttgaataagatagatgggttttatcaatgtcaatatcccagttgtgatatcataatatagattaccaggatgttaccattgggggaaaagggatctctgggcattatttcttagaactgcatgcatatttccaatatctaaaaatagtttgattaaaaaattgagacacagtaattgtagttctttacaatatttgttaaataacaagataaagtggcaggttgtataactcaagtaattttgaagaagtgataagcataaatgatagttaaggtattttcacaagtgcactatgtgtggtataacaggaaaataaatgtgacttggtgaccaagttgcaggggctgctaataccactgtaatctgtttcctatattcatagttgaaagaagtactagatttaagtaagaggttactgaaaatatgttttcctttccaaattcacataccccctaaatttagaccccaggataagaacccctgactttatatctttttacatttcattatctgttatatctcaaaggcctctgtcaaataaaagagaaacataatgtgtatttgttttgcctcaaataccatggataatgatgggggctcatagaaaatactagtggacacacttcacagttttaatgatttacttgctattactcacccatatgcccattgttcaccaaaattgcttaacactagttttaaaagagaagtatatgtggattttaagtatagaataaactacacattattgatatgaaaaagaaatatgtcaaattgattgcttattatccagattgactaatattgactatcattaaatattttaatttgctttcgctaggaaatcagttaatgatggtttagccttcaattgtccgtatctctgagagtatctagatcaaatgaggctattgttttataagaaaggaaggttagtgttttgggattaatgttctactttaaaatatcacctttttgtttcctctaatgttaaaatctaaaattttttgaatatttgagtaattatttgaaattattatgaagtatttcctctatactctattggttaaatatgtctttcataacataagaagtaacaatatggacacagaattaaaaactatgtttagagtttgtgtacttgacatttctaatacaggctgagcatctctaatccaaaatcgaaaatgctccaaaatccaaaacttcttgagaaccaacatgatgccacaaatggaatattccacacctgacctcatgtgttgagtcacagataaaatgtggccaaaactttgtttcatgcacaaaattattaaaatcattgtataaaattatcttcaggctatttgtatgagttgcatatgcaacataaataaataacatgtttcaacttgagtcttgtccccaaaatatctcattatgtatttgtaaagattacaaaattggagaaaatcagaactctgaaacacttctggtcccaagcattttgaataagggatactcaatctgtaatacaagtgctcaaaaaatcatctaaatatttgttctgtgatggtctaagagtctgtaatttgggagtgaaatgcttaattgatatttagtagacagaagcttcaataagggaacaataaatgatttcatcatatacaaccttatacttttctttcattaaacattttagctaatcatattttagtaaacttatttaaatttttttgggaaaaatggcacatataatctgaagaattatgatgcttatacattgctgtagaaaagcttttatcacccctgccctataatttgcggtatattctcttgttttgcctattattttcatcctctgaaaatgccttagttagaaacagtgtttcctgcaatgggaaatgacacaatatgaagttaacctgatgacagtaattttctgtgtaggtttttttcttatagacttcaattgataatatgtagtatcttttaccctacatttttttgtgtggttaaaaaaaataaattaaaaaaagacttaaaggttagacctaaaaccataaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcaccgcaaaagaaactaccatcagagtgaacaggcaacctacagaatgggagaaaatttttgcaatctgctcatctgacaaagggctaatatccagaatctacaaagaactcaaacaaatttacaagaaaaaaacaactccatcaacaagtgggcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactggttcaaccactgtggaagacagtgtggtgattcctcagggatctagaactagaaataccatttgacccagccatcccattactgggtatatacccaaaggattataaatcatgctactataaagacacatgcacatgtatgtttattgtggcactattcacaatagcaaagacctggaaccaacccacatgtccaacaatcatagactggattaaggaaatgtggcacatatacacaatggaatactatgcagccataaaaaatgatgagttcatgtcctttgtagggacatggatgaagctggaagccatcattctcagcaaactatggcaagaacaaaaaaccaaacatcgcatgttctcactcataggtgggaattgaacaatgagaacacatggacacaggaagggcaacatcacacaccggggcctgttgtggggtttggggaggggggagggatagcattaggagatatatctaatataaatgatgggttaatgggtgcagcacaccaacatggcacatgtatacatatgtaacaaacctgcacgttatgtacatttaccctagaacttaaagtataataataaaaaaatttttcaatgcaaattgcatattaaattattttaagttttattataaattgattttaatatattttttatattttttgatacataaattacataactgtattactctcccagtaagagatggctttcttacataaatggagagaagccatctaaaggttctgcactatatagcattctctgttcaaaccaaatataccgctatcagaataaataaatagattcacttggatagggcacttattttgtgtttccctttcctccttgaactcaaggaactgatggtgatgaaaatggcattttgatttcttatgtttgaaagttataggagcctctccaagaacaacagtatgaacctttgtagatataatcccaaatatgttaatctatagcattatattttcagagaacatgatgatagattagaaacttatttgattaaaatagccaaagaaatggacttcattagggtttgtaaatcatggtcaataacactaacaaaattactgttttcatgaaaatattgcccatcctatttgaagatgacatccctgatactaattgctatctatgtgcatgctgtatagctgaaaagacctgtgtacaatcaatagttctgtctagtgtctgcagcaagatacctttacagctaagaaccataaagccttttcccaagttgtaagtaagtctgtttttacattaaaaaatgacagaccatgctcagactaagtccatctaaactcagaagtgattatctccactgcaaactagaagtgttctttcttagaatattgcttctctgctgttgattttaacatttcatatcagagcaaggggaatctgtgactattaaactggcccaaactaccttttgattatttgtgtactgtcttaaaataatacaagcccagtcacattgactagtatctccatcctaatgattttcaaattaaggaatggcttcaaattaggaaagctctttgttcacctaggtttggaatagcatgatgtatgctaattgctaactttgtctgcattattttttaaagatcaaatgggcacagtggtaattttcattaatctcatacagagcagctaattaaaatttccattattacccatccattatctagttgtttcctttgttcagtatcagaacaggatgttaataagccattcttgtcttacagccctattaagtattatgagaattaatgtattgcactattttgtttttaggtgattttaaaaatattttcttgcaccatattgattatactgaaggtactttgacaccttgacattttgtaatagagatttcagaattaaatacttgttgctttaacgttttattcaatattgagcaaaagtagtatatagtagagacaggagctatccaaggaccagaatatttgttttagtctcatactcttactgattatgtgaacttaggcaattacttggattcctcatttttgtaatgaggatattagaagaactgatctttaagggccagtccagccttagcttgctatcatattttcataattttcaaatatgaacttatgttaaaatctcaaagtccttctaagcttggtaaaaagcatctgttctataaagttatatattctctgtcatgctctagtagattgtttgcttccattccttataaccagagaggatcctaaattttataatttaagcttgtttctaagacttgggtggggagtgagccacaaagtgatgggctggctcacttgtccacaaggagtacctcggccataaccatatgtcccaattagactaatcctgtagggaatcaattagaaaaagggaaccaacattttctcagtagattattctgtgtccatgagatgcccaatataaaatacctctgagctgtcctcagcataccatacagtgtctcagtttacctgttctatattcagcatctctgaatatattacaactgaaagtctcagaactataatattctgaagcaaaactaagcttagaatcttcagcatgttgaaactcatcactcatctacccttttgtttattctctatccatccatccacccaaccatccatccattcattcattcaggaaatatgtattgaatgcttacttaagcactgtcttaagatctgaggatatagtggtgaacaaggcaggcaagaatcctgtcataagagcttatgttttagcgcagaagacagtaaacaactaaattacaaaaataaattttcatagaggtaatactgtaaatgatatttaaaatggtgttgcgatgataactagaatgtggggtggggagaagactatggagctgagattaaaatgatgggagccagcaatggagaggttgggataagggtcttcaaggcagagaaaactgcaaaatacaaaggtcacgcaacagggttaaattccatatacaatcctctaggggaagattagtggtgcctttttatatattaatttagaaataactttgaggattatatgaaagcggtatgtgactacagacttgaaaattttaattcgttttactagtagttttcagactggcacatgtagtaaatagatcccttgttactgatgaactttgtgttgttgtagaaagtgagttggccgagcaaaaataaaactataattttgaatttgcaaaattatgctttaaatatttacttgctattattccttgtgaaataatagatggataaggaagttacaggaatatggacatgatctctcggtgatggttttacttactgtgccatttaggtgatgatgattcatccagtatacttttttatttgtggaggagacggagtcttgctctgtggctcaggctggagtgctgtggcgggatctcagctcactgcaacctccacctcccgggttcaagctattctcgtgtcttagcctcacgagttgctgggattacaggcatgtgcctccatgccagctaatttttgtatttttagtagagatggagtttcaccacattggccaggctgatttcgaacccctgacctcaagtgttccacccgcctcagcctcccaaagtgctgggattccaggcatgagccaccgtccccggcccatccagtatatttttaacgtctactgtgtctcataacgaagcaagaaataccaagtcagtggccattatacaaaatatgggagctcaaagtatgaaatcgtattccttgttctgcagttattatggagaagttcaataataacacacttttattgaagctcactaaattcatgaccggtgttagttatgtggcatagatggagttcccaatgtagaagtgagacagacacaaataatgacctctaccacaatattttaagtgctataataattataatattgccacagcgctaagggaatagagttcccctatatgttataagcctttatcagactttaaaaatttagcatctaatgggatttttgaaattcagaaattaagaatgattaacactttctacattgaggaggcattctcaataaaaacccaaatagtgtgaaatcatagggaactcatttctcattattaacatttttttaaatgtcatatcctctaatgataatacctctacccaatggggaaaaattcctttccttatgatctccttataatattatatttcctatgatagtatatccttatgatgttattttatagtaagtatccttagatgcttagcagaaactgagtgtaatttttatgaacctgtaaaatgggactcaagcttggagtcttaattcagggatatacatttacagtataggaaaggggcaattatgattaggtacgtctagaatgtgaaactatcagttgttagtatagtgaatgtgttgacaatattttcctcccagccttttccctgaactacttatatagttatagcaagatgatgaagttaaggagctgtgatgagatgagttctagaaacaactccatctatattgaaagttaagttaaaaactagtcactatcagataaatgtatttaatgactttttaagattaatctacaacctgagagtaccagaaaggaataattgggaactggtgaatgctttcaactgatttgattaattaacatgctaattggagactatattgttttacattttaataactgttttcacttattttttttagaaaggctgatactctgatatctttcaatagatttgggttatgtataatggtatatattaaattttatttgctggattttgtggaattgaatatacatatcttaactaggaaaattaataagatgatttttgaatgcttatcctctgggttaaggaggactagctaatattaattctaatgcctgaattgtaaatttaagcacccctgtcaatgacactttatgtaattcaagttcatattctattcaggtcatgagcaccagcactgtaattttttttttaaatgaggttgaggaaaatgttgagatatatacaacacaattttactatatcaattctgtgatcaagaatttttaagtgtgtagcactctgcacacatttttatataacaaaataaatattctatgcattattttacttaaattttttttgaaacattgtctaaaatggtctctttgtttattttatagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcaggtaagtcgttcttatcatttcggtatgattcatacaatttgtagtgcatataattgtttgggaatataataagttttgttatttaaacctcaagatttcctgactaaaaatctgatgttaataaaacagcagcatctgattgtgaagtcgtaaacttttaaaaatatatttagttagttggatctctagtaatgtacaattttaagaatacaaatgttaacatagagccagaagttaaatatccacatttacatggaaatctatttgtgggatcagataattattatatatttatttataaagcaaattaagtatatttgctccatgattttattcttttttttttttgtgagacagagtcttgctctgttgcccaggctggagtgcagtggcacgatcttggctcactgcaacctctgcctcccaggttcaagcaattcttctacctcagcctcctgagtagctgggactacaggcacgcaccatcatgcctggctgatgtttgtatttttagtagggaaggggtttcaccatattggccaggctggtctcgaactcttgatctcgtgatccacctgccttggtcttctaaagtgctgggattacaggtgtgagccaccgcgcccggccgattttattcttttaaaacttgaaaggtatatataactttatgttcttctataagttttagatatactcttcacatatttctgtaattttgagatagcaaaaagtgaattattttaaccagtaaaagaagtgagagcattaataaacttctcaaaactctactaatttaggctattaactaactacaaaggattgttattaggttacttgccaatggtggattccagtaactgtggttcctttattaagcctttaaatcaataacacccaaaataaaatgttttataaagaaaaataaaatttcaataaaatatcaaaacattcttggccgggcgtgggggctcacacctataatccctgcacttcagggggctgaggcaagtggatcgcttgagtccaggagttcgagaccagcctggccaacatggtgaaaccccgtctctaccaaaaatacaaaaaagtcagccaggtgtggtgatgtgcgcctgtggtcccaggtattcacgaggctgaggtgggaggatcacctcagcccgggaggtggaggttgcagtgagcccatatcccgccactgcactccaacctgggagacagagcgagaccctgtctccaaaaaaaaaaaaaaaaaaaaaaaacaaaaaaacaaaaatccgggatctatttatgtaactactagaatcttaagttcagaatttactccataagagtatataaaaaacttactgtgattttatccatgtttttcctaatatataataggtctaagtcttgtacttttctgtcctgtccacagagccttgaaaataatttagagctcagtcattcagtttggatttatgtataaattgaaatatattaattacttatttatagtgcacttggcaaaatgcccagaaaattacaattttaaaacaacaaaaaattttttaaaagccagtgttaagatgtgacttatcttagagtatgataatcgttgaaagacgattgtcttgccatttcttccaaaatgctcctaggttttttgttttttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgtgtcagtggccattagaaaaaccactaattcttgcctaagctttgtgatgcatatttttcttccccttgaaagtaaagaaattgtaaatggcactcttgaaaagcacagatgaataacatactataaacctgttacttaaattatcagacattttgaaaattctggtcttcataaacctaaaatattcggaaccactttttgttgaaaaaggttacctgtcctagggaaaatcatactgggggagaggcaacaaggggcatatatacttggaattgtggagctgaaagagtctagcagatacaatattcttttgtgacattaaaatctgatatttatgagtataattataggtcactcccataattgcttgagctgattcagctggccagtggatgcgtagccacttgtttttcctatactaggagcatgcggagggggaaaaaaactcttttttttttgtttgggaggccaaactgcttttgtccctgcaaactgatacactgagatatgtacacctgaatttaaggcagaagaccaacctctctcccatcctgtgaggggaaatgtcctctatctgtgttcgttggggtttttttaggcttttaaaattactcctcccaacgcttattcttctgaatggaatcgtgtgctttagtggattctgctgcaggtaagagatagcagtggaaaaatagtaagtaggtctagatataatgtcagtggaaataaaacacttttaggcagaaaatcactggattgttttatacatgtatatttagtccatgttaaaggtagcagatttttaaagttcattttgaacacccacctggcatgcatactttttcaattttgtttagactgggaatgacttggctaatatcccctttctccaaggtcctgccctgatagttagccacaccttttgaggataagatacaaatcctggggacatactattgactattttgggcagggacatttaagcctgaggaacctgaaaaacataattgatgattataatccacccaaggttttttcctatggctcacaggcttacgaaatgtatgtatttatattgaggttgattctaaattaactatgaataaatatatttgaaagtgttttcaaggccaatataataatcttactatggtcataattattagtgatcattttgttacttttacctactaaatttagtaatatttggagtagaagctgaaaaacataagttcttatattttttcaatttctgtttactttttataacagcaatttaaaaaatgtaactagcaagaattatgtttgttcctgaaacctttattgagttcctactatatgcatttaagtgttaactttaattttgataagcttaaattttattgacttctgaaatgcttattaaagatagtaatagttaacattttaacatttatttagtatttattatctcccaagtactgttctaagagtaggagttgtgtgtatgtgttgtgcgtgtgtgtatgtgtgtgtgtgtatgtgtgtgtgtgtatgtgtatgtatgatccctgtgatgcgtagatttacgttttcagctcagacctctctgtttctctctctctttttttttttgagacagagtcttgctcttgtggcccaggctggagtgcaatgtcacaatctcggctcactgcaacctctgcctcccaggttcaagtgattctcctgcctcagcctcctgactagctgggattacaggtgcccgccaccatgcctggctaatttttatatttttagtaaagacggggtttcgccatgttggccaggctggtctcaaactcctgacctcgtgatccgcctgcctcggcctcccagagtgctgggattacaagtgtgagccacccacctggccagacctctcttttgaaattgagactccatctccaaatgtcttattggatgacatataggcatttttaatacattaaaaaataatgaaaaattatgtgtgatatgtgttttttatatatatatataacacagatatatatctctatatatgtacacacagatacatatatctatatatatacatacagatatatatatctatatatatacacagatatatatatctatatatatacagatatatatatctatatatatctatatatatacacagatatatatatctatatatatattaccatgtatatacagatatatatatatctgtgtatatattagtatgtatatggcatttactacccctgtgcaatgttttaagacctttaaatgtacatatacaatcaggataacagtattgttcgtattttgtagatgaacttgaggctcagagaggttaagtaatttgcgccatattaaagttgcatgcccagcaagtgtcagtgttaagatttaaacccaggctttgtatctctcgagagcctaggcctttaacaactggtttgtacagtgtcacaataaggaaagtctattaaaatagtattctttcactgttgttagtattctttcactgtcatcacatactgaatattttgactttctttcattaatatttgtctgatttaaatgaaaaagaaactatgaaaactttcagcaaatgtgtagaagataatataaaaacacctttgtactcatctatcagcttaagagacaaaacattattttttgctgtggtagagaacttagttgaataacttgggagtttttttatgatatcgtaataccatttgggcctatattttcattgatttaaaagatcgtctgaaattctacattttctctaaatctatgcatgtagtttttgcaatataatatcttaagaatatatatcagtgtattgaaaagcctatttttttttctgatcacatagctgtgtgtaaattgggacttctttgccctatccattgtggatgatacttctagtaattctaacaccatctctatgatatttattccaatttgccatcatgtgataaattacgaaaacaattttttaacattaagagttaatttcctttggtaataccttaaattggagaagttcaataaatagcacttaatattatgtggtttgtttttacatatcacatggataatcctacaaaggaataacaaaactaaattccccttgtccatatggggcttatatatatggagcttacattccagtacaggaattcagacaatttttttaaaggtgtacatcaaatatcaggttgtaatatgagctgaggaggagatgttgctattttatattagatgatcagtgaaagcctccctgactttaatgacatttgcacagaggtctaaaggaagtatggcagtgacctatgttcactggaggagtaatgttgttagaaacggaaaacagcaacagcaaataccaaagatgggagcatgcttggcatgttctaggaatgtcaaggaggctagcatgctggaagcagataatgtagagccttattgaccattcaaaggactttggcttttactttgagtgagctgggacactgttagagagttttgaggaatggaatggcatgagatgacctacatttttaaaggatagccctgggtggaagcagggagaacatgttgtacattactcaggcagaaggtgccactggccacagaggtttctagctggtgaagtgacaccccaggatcctgtgacaatatgataaatcattctagttcttgatcactcctctgtggtgaccttggtccagtcaatggacctctttggtcctcagtttcttgatatgtaaatgggattggagccttccagctctaagcctctgtgttctgtattttcttttgcttagttttaatcctcttacctttgctattggaactagattagtgtttaggtattattttgaagagtgagaagaatgttcctctataaggctagaggatttcctaatgtttcattattttttgtatttataaatgtatttaaccacccccagacagatatttataatttcctttaaatacggatgaaagcagttcctaaaactctgttgcataactgtttttgaaacctggtgttcattagaacccacaccgttgtcctctcgtgggtaattctcctccctaccacagttttaattggtttctttttgttcagcccctcgtaaaatttaaaaatatatataaataagtgtacacacacacacatacgtatacatactaacagttttaccaaacatcctcaaaacagtcattttggaatattaagtggggtcatgaatttcaaattcacatggtatttaatcactcaggtgataaaggctctaagaaagtcattttggtatattattttctgctaaagcaaatacttaaaaatcccttttataagccctcattaactggtcctatctcagatcactctgttactgtacatttccctcaacatttattttttactatatacatttacctgtgtctgtttatactctgtaatagtttcatgcatgcatgtctgtttttctcatttagattttagtctcctctggggaagggaccctcttaccctcttatttgtctcgtggtggctggtactgtgtaatttatatatactaatgtgtgatttgatgtagttattgacccaccatcaataaaaacctatgcttctccaccagtgggaatgaatttgcattaatcggcactattttgtggccatgcatttttagctgtaatcagaaaaagaatgaagctaacttcttccacataagaatgaaaccttggtttgaatcatattcacaatccacagacaacatagcatgctttacacaatagccttgttacagttgcatggtgaattaatgaaattgaatgtttacaactctatttaacactctaaaaatccatgtgctttgaccgtaaagtaaatcccaatctgccatcacaaattgcattagactttgcacataccatggtctatgtgtgatttagaatgaggactctgttatttagagatttttgttcatatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaagaagcagatattctacttccgtaagacaaaggtaaaaatgccaagctccaattaaatgaggaaaggaggtggaacttttccaaaaacttaggacaatgtcaggtaatgatttgagtataatgtagatccaagtttctttgtgtggagtggagaggggtcggggggtgtttatcaggtaaacagttctgtctctcagtaaaagtctctcaataaaaagagagacatagctgttacctgataaacgacattgcatctcttttgtgttgttgtttgtttgtttttcaggagggtcattcttcctaattctgaactcattttattttgtggttctttaaatgagggatattggacaacaacagtagaatgagtccttgatagttttccataaagtacagaagatttctatgaatgtccatttcctgcatttagccaaaaagtaaaaaaatcaaggttatgatatttctacaatgaccaggaataatagtactggaatgcagctttctagtaatctaacctgctaccaaggtgtacttgagaaatgcccctgaggctctccccttggactgtctatcatctcagctggacttttgatagaagttggatagctgacaactcacaattaagatgccagctggcacctggagtgcaagtagtctgtatagttgattgaaagaagatccatgtgcactagataacagtatttgctctatgaccccagctgttcgactggtggtagataatggacagctaatttggggagatttgccacctggtcagcaaagctgtaagtgtatagcctctcacaccaggcagtttaaacctggaatcttctgttaagatggaatccatgaaggcagaatatagaagataacataatgttatagtacttctaaaaactaaaacatcttcaaatgagacagttttggtgacctcttatatgaatatgaatttcaagcctttcatatacccgaaatcaacctactcctgttaggtcagttctgcagcatccagtgttattgaacatatgcagattgactctatttctattttggaggatattgcctgagtactgagtactgctacagtttttttttttttcttttatgtggtaccatacttcccttgataccagcttccaaaagaatttcctggagatcatatcttaaattggtacgttcaacatttattcatcaaaaactattgaagattggagtgctgtagttaaacacatttttaaaaattgagttataaatttccatatgtgaattaatatctgtcaaagaatatcttgaagtggatacagcactaaaactatattaagtattaatgaatttttcttcgatatagagaatgcttaagaattttatagtgcctttgaggttcgcattatgagcatttattaagatggtataatactttaagtgtaagtggtgtgggacatcaagctgggggtattctctgaccttgtgatatgctttggatcttcaaaaacttttctgtcagtttatgtgcttgatgagcaatgatgttgctttctcctgggaaggagatgggttattatgtgggtttatcattaattttggtttctgttaccatttttgtattgtttgcaaattataatgatttatctgttgaaatcatgtgtcttaatttgctgatgaccatagtttgattcaagtattcaccttattgcatttcacaatgtgcttagaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaacttattttatttcacaaccagaaaagctactcttattggtgtgagttctttcatggaggtttgtttgtaaatgaagaaaaatccatgtttttaattaaaattatttgtttgttttggcttttaactgttccaattaaaaagagagtctttgttattttgaataaggccaaagttatttcagcaattaagacgtgctttctttacaaagcatttatatgtttgaaaagctttagcaaggataaatgcatatcttttaggtgtagctatatttctagagttttctgaaaataggtacaagtcaggttgacaataacagaaggctgatatctcttagggactttatactgcatttagtcctacaaatgctttgtttgtatgtcatgtatatatttgttatttttgtgttgttattgctttagatggtttatttcactataatataagaaaaataatagcagatttggcttattttgtcttggataaaagccttaacaagttgtttagtgggggattattaaggattttgaatattcgttgtatttatgttggtcaaaggatacaaaatttcatttaaacagaaggtgtaagttcaagagattcatcgtacatcatggcgactgtagttaataccaatatattgtatacttgaaaattgctaagagaagaaatttttaaaagattatttttaaaatttcaatagttttgggggtacaggtggcttttggttacatggatgagttctatagtgttgaattctgagattttagtgcagacatcacccaagcagtgtacattcattgtacccaatatgtagtcttttatctctcacccacctcccaacatccgcccacttactttgagtaatgatggtattttgatggaagttgcaatgaatttatagatagcttttttttttcaaacaggtcttagtttattccaagttttacaaagtcaaagttgcataagtcttacaaagtcaaagttgcataagtcttacaaaattaaagttgcaaagtgaatagtgaagcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaaccagtttacagtcccaccaacagtgtaaaagtgttcctatttctccacatcctctccagcacctgttgtttcctgactttttaatgattgccattctaactggtgtgagatggtatctcattgtggttttgattttcgtttctctgatggccagtgatggtgagcatttattcatgtgtcttttggctgcataaatgtcttcttttgagaagtgtctgttcatgtccttcgcccactttttgatggggttgtttgttttttttcttgtaaatttgtttgagttcattgtagattctggatattagccctttgtcagacgagtaggttgcgaaaattttctcccattttgtaggttgcctgttcactctgatggtagttcttttgctgtgcagaagctctttagtttaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttccgagggctctgttctgttccgttgatctatatctctgttttggtaccagtaccatgctcttttggttactgtaggcttgtagtatagtttgaagtcaggtagcgtgatgcctccagctttgttcttttggcttaggattgacttggcgatgtgggctcttttttggttccatatgaactttaaagtagttttttccaatcctgtgaagaaagtcattggtagcttgatggggatggcattgaatctgtaaattaccttgggcagtatggccattttcacgatactgattcttcctacccatgagcatggaatgttcttccatttgtttgtatcctcttttatttcattgagcagtggtttgtagttctccttgaagaggtccttcacatcccttgtaagttggattcctaggtattttcttctctttgaggcaattgtgaatgggagttcactcatgatttggctctctgttcgtctgtttttggtgtataagaatgcttgtgatttttgtacattgattttgtatcctgagactttgctgaagttgcttatcagcttaaggagattttgggctgagacaatggggttttctagatgtacaatcatgtcgtctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagataagtcccatcagtacctaatttattgagagtttttagcatgaagtgttgttgaattttgtcaaaggccttttctgcatctattgagataatcgtggtttttgtctttggttctgtttatatgctcgattacatttattgacttgcgtatattgaaccagcctgtttggcagcatggtcattttcacaatattggttctacccttccatgagcatgggatgtggttccatgtgtttgtgttatctgtgatttctttcagcagtgtttcgtagttttccttatagagatattttgcctccttggttaagtatattcctgagtgcttttttgtttgtttatttgttttcgttttgcagctgttgtaaagagggtcgagttcttcatttgactgtctgcttggtgccactgatttgtgtacattgattttgtaacctgagactttactgaattcatttatcagatctaggagccttttggatgagtctttagggttttcttggtatgcaatcatatcatcagcaaacagtaacagtttgatttcctcttttccaatttggatgctctttatttctttctcttgcctgattgctctggctggggcttccagtactatgttaaatagaaatggtgaaagtaggcatccttgtcttgttgctttcaacttttacccattcagtatgatgttggctttgggttggtcatatatggcttttattactttgagggaagtcccttctgtgcctcggttcttgaggatttttatcataaagggatggtggattttatcaaatgctctttctgcatctattgagatgatgatatggtttttgtttttaattctgtttatgtgatttatcacatctattgacttgcttatgctaaactattcttgctaaactattcatccctgggatgaaacccacttgattccgatatattatgtttttgatatgctgttggattcagttagctagtattttgttggggatttttgcatcaatgttcaccagggatattggtctgcagttttcttttttgttacgtcctttcctagttttggtattacggtgatactggcttcatagaaggattcagagaggattccctctttctcttttggaatagtttcagaaggattggtaaaaaatttttctttgaatgtctggtagaattcagttgtgagtccatctggtcctggagtttttcttgttgacaatttttttttattactgattctatttccttgcttgttactggtctgttcagagtttgtgtttattcctgatttaatctaggagggctgtatgtttccaggaatttatccatttcctctagattttctagttttcgtgtgtaaaggtcttcatagtagtcttgaatgatcttttgtatttctgtggtatcagttataatgtctccagtttcatttctaattgaggttatttgcatcttctctcttctttctttaattaatctcgctaatagtctatcaattttatcttttcaaagaaccagctttttgtttttttaatcttttgtatttttttttgttgtttgaatttcatttagttctgctctgatctttgctatttcttttcttcttctagctttttggattttgtttgttcttttctttctgtttttttttttttttttttttttttttgagacaagggcacccaggctggagtacagtggttcaatctcggctcagtgctgcaacctccacctcccaggttcaagcgattctagtgcctcagcctcccaagtagctgggactacaggcatgcaccaccatgcccaactaatttttgtatttttagtagagacagggtttcaccatgttggccaggctggtctcgaactcctggcctcaagtgatctgcccgccttggcctccgaaagttctgggattacaggtgtgagctactgcgcccggcctttgtttgttcttgtttctctagttacttgaggtgtgacattaggttgtcaatttgtgctctttcagactttttgatatagacatttagcactgtaaactttcctcttagcactgcttttgccatataacagaggttttgataacgtgtgtcactagtaccattcttttcaaataagttttaaatttccatcttagtttcattgttaacccaaaaatcattcaaaaccagactaatttccatgtatttgcatagctttgagggttccttttgcagttgatttccagttttattccattgtgttctgagaagatgcttgatctgattttgagtttcttaaatttattgaaacttgttttgtggtctatcagatggtctgtcttggagaatattccatgtgctgatgcgaagaatgtatattatgcagttgttgggaagaatgttctgtagatttctgttaagtacatttgttctaggatacagtttatgtctattgtttctttgttgactttctgtcttgatggtctgtctcgtgctgtcagtggaatattgaactctcccactcactatgttgctgtctatttcatttcttaggtctagtagtaattgttttataaatctgggagctccagtgttaggtgcatataaatgcaggattgtagtatcttcttgttggtcctgagagaggagatttttaagtgttctcataacaaataaaatcaagtatgtgaggtaattcctgcgttaattactttgatttacccatttcacagtgtatgcatgtgtcaaaacatcatgttgtacagtataaatatataccgtttttatttgtcaataaaaataaatataaatttaaaaaaacacatatttaaccatggttaagaatgtatgtatgtgcacactgaagaacatataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgtttatgatgtttatttagccgaacaaattttccttttaagatgcggaaaatactaaggtttacttggttactgtttatgcagatttgatccatggactgaatatgtgatactgtttatgttgggctacatactggttttaatcacatggaactctttctttccttaagtgtatgcaactaaaatttggttttagttgcattaaaaaacattacagtagcaatattggtgtttaagtgagatgttttcctattttaaaaaaaacaaaccaaaacccaccactcaagataacatttaaagtctcctcaaccttttgaattagttgtttcacatgttataattttaccaaatttctgaattcccccaagaaaccctgaactatcattcattttatttgatgttccagtgattcaggttgtagtttgagattacacatgggaatagaacaccattagagggaaataaaatcctttgtacagaacacataaccctctatactagcctttagcactgcacaaacagtgataaagggatgacatgactaatattggactccttcacatgagaccaattgcctttacagcttatgggattcagtatagaagtttctaattttagctttaactcttttgaaagagatgttaatttggataatctaatcattgatggacatgcagtcactattttctattatatcttcattgtatatagcatactgaactcatctgttcattacatctttggttttacattatatttaagtgaaatgtaactaaataattcagagtctgaatctcaaatttatgggagaaaggttgaggttttgggaaactgtgaaatgttgtcctttataagaatctatgagggagcacagtcttattccctccttcaataggtacatttatagaaaattttcctcgttttgctttgccctgaagagctagagaggggagaatcttgctttctcttagatttagggttaattgaatcttctgataccttcattaaatgtaagattttctttcctttgatcatgctgatcagtataagtgggtcctttaaaaataatgaccttagaagttctaaaggcttgagataggtttctgttttaaaacttcaatatatttttgatataattctgtcaggattatacatgaactaaaaattctctccccctcaccattataatttccatatctattctgatgtgaattggccagcactaaatacaattagaattaagtatacacaaaattggatagtgaccagttaaaacacatgaggttggctgggcgcggtggctcacgcctgtaatcccagcgctttgggaggccgaagcaggcggatcatgaggtcaggagatcgagaccatcctggctaacacgatgaaaccccatctccactaaaaatacaaaaaattagccgggtgtggcggcaggcgcctgtagtcccagctactcgggaggctgaggcaggagaatggggtgaacccgggaggcggagcttgcagtcagccgagatggtgccactgcactccagcctgggaggcagcgagactccgtctcaaaaaacaaaaaaaagaggtaatatgagtaccaaatatttaaattataaagtctggcctcaaactcttgggctcaaatgatgcccctgtttcagcctcccgaatagctgagatgacaggcatgacactgtgccccagtcttatttttaaacaagtcaatagagtaagtttagtataattttagtcatctgcatgttttgtaaaaattaatataattttcattaagtgattaaaagttgtgttaatactgtggaaaaggattctttaatttatgcctaaaattcatactgcattttggactagaagattcaaacaacattcagatttttggtttttaacattttccaaaaatttcttaatggctttattgtgatgttttatatacattatttcatttaatagtcacaaagacttcatggggtataggtagtattctcatccctattttgaaaatgcaaaaacaagcttagaaaatttacgtatattatcaaaagtaacacaactagaatatgtagagatgagattagaacctagatctgttttcctctaaagcttatgcatttagccatgcagctatgtggccccacagcataatccaatgatggatgatggaatattttctttatttttgggtgaacttggaaaaaagtctttaatttttagctttttgagcagcgtaacagatattagcctccctgatagatacagccaaaccttttttacatagggttggaagatgctgtctcactgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagataaacaaattgtggtatattcatacagtaacaaggaatggaatactaatacatgcaacgaaatggttgaatatcatagtattcatgctaagtaaaagaagccaaacacaaaatttgaaaactgtacaattcttttataattatattctggcaagcacaaaactatagggacccaaatcagataagtagttgccaggatgctgggagtagggaaaagggattgactgcaaaggggaataagggaatattttagggtgatgaaaacgttttatatcttatttgtattggtggttacatgactatacatttgttaaaatgataaattttactatatataaatcatacctcagtaaaaaggaaagaaaaaataactcatgtttgggttggttatgaaaattattaagagtaattttcctccgtttttccttctgtttggttcttcattattctctgcctgttctatgtccctcataaatgtaaggtccatgagaaatgtcagtttcttatttcagggctgagatagtacagaaaaatttatgtctttgtctgtaatctctgagtaagattttaaatcaggtcatcaactgtattcttatcattctagatgttccagttagtactaaataattcagagctggaatttgcatactccatgaaatataccaaatatatctgtttcaactggattccttttttttgtttgtttgttttttttgagaccgagtcttgctctgtggcccaggctggagtgcagtggcgcgatttcagctcactgcaacctccgtctcctgggttcacgccattctcctgcctcagcctctccaagcagctgggactacaggcgcccgccaccacgcccagctaatttttggtatttttagtagagtcagggtttcaccgtgttagccaggatggtctcgatctcctgacctcgtgatccgcccgcctcggcctcccaaagtgctgggattacaggcgtgagccaccgctcccggccctcaactggattcctgatctgtgttctgcggcactgggagggcacagtatggttgggagggcatgtaaagcagccttgagttctgagcctgagtcttgcctgagaaaggcttcccctgcttctcagcaatccattgttccctgccagtggttctcaaacttgagcaagcatcagattcaccaggagaattagttaaaacatacacttctatcttcctcccagctactgattcagtaggtctgaggtagggcacaagcattttgatttctaacaagttcccagatgatgtcaatgctgctgatttggagtgcacactttgagaacccttgatttatgcttacttctagtgtttcaatgtcagaatttctgcccacatgctcacatacaggagccaacattttgtttttaaactgcctcctcatttcatgaccacttttgtattggctgaaatcagtatactctatgtatatgagaaagggaggctgggggaggggggtggaggagaaagagagaaagagaagcagtaaaacagtaagtgcttggctggagttcacaaagtgtttgatgtctgaaaggcagagaaatggtggtgctggcaagagaaaaaggaaacaaagctatgtctagccacacctccttccttttaacctcttgcgcatcgtcatcgttcgtaattattttatccccttagcaacgggctcatttcaggctcccattctctctactttaaaagttttaaagactcttactaggcctcctctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgacttaaaacagccaattttagttttaaatagttgggagaaatggagttgaggttactttctgggaagaaagaataaatgagctaacatgaggaagtgcaaggtgggctccagcaatgataatttgtctgattttattggcacatgtgtcttaaggcctgaggctggaaaggtagattgaggctacatcagaatgttgagccaaatgatttaaaatgtattaagtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggttaaatacacatttgaaaccatatataaaagataaatttgatgtttaattttccaaaatgtgagctattgttagttttctcgatttttttttttttatttctatgctgatatttcattttaaccaaagaagtcctcacagcatccagaggatttcagggatgatataacttctgtagatctaaatcttttaaaaaatggagccctattccaatgtttcttctattcaaatatattgctttcatatagggaagatagataaaacagtactttccattgtctatgctgctaatttcctcaggagggtgagctagtcaatgaaacaaacaaaaaaaatgattggaaaaagtgtatttgactcttgtctataatttagaaatgctgtgtctgattcttattctgtttattcctccaataatttctttcatgtgaacagaggtctttttgattttatagtatactaaatgttcagaaaacataacaaaaagaaagaaatgaacaaaatagtgagtgcttgttcagtttacaaaagggtctttatgatgtaaatccttataatatttaagtaatacttacatgaaagttatactttgcttcacaaaatatttattggtgggtttttgaaatcatgcaaatgaattagtgttgttcccaattttggtaataatgctttttctttaatggtagtaggaaaatttaaatgtcgtttgttgaatatgtttccacacagagaatttctgttctattgaaaaggaaaattatagggatgggttgacttatttgctaagaacattgtaagattgagatttctctttcttttatgttttattaatgtcagcaagtttacatacatataagacatctctgaaaaattgcagggctttttatgtatatgtataatactagttgtattataagggaccctgtgaattttagacaataatttttcttctaaaaatagactttactcaggttatgaagttacagtattttttctataaactattttttttactgtcttagaaatgacctcttcatacctatagataaaatactattgactaattcacttaattacctaattccctttacatagtattttaataatctcaaaatagataatagaaataattacaacaacaagtagaagtttgccaaatgtaaaatatggctattaataaccaatgcaataagattatatattaatctatagacagtctcaagcatatggaaatacatataagtatttatatattatacatacatgtatcagcaaagaatgttactgtatgagcatatgcaatgaatgcttgctagtggacatgagactcctgaatatgctagttgtactgtttctggaagtttcttacagaaatattcccatcactactagtacagattttctcaaaatctgggctcttagtctttggctacaaagttaaacagaatctgatgcccaacaaggaaataatgagcattgcttcttcacagctcaagatagatctctttcgtcaattgagggaaacaatgacataatggaaagataacacagttctagaattcaggagatatatatagttcatgctttgttcctaataagttgtgtggcctttggaaaattacttgacctctctgagtatcagtcccctcatctgtaaatttagctataggacactttgttctaaattcttattgactcatgttgtcaattgtcgtggcttttcaggatgctaagtaattttaatcaggacagtcactagagagagtcataatagtaagattcttatagagccctttttttttttaacagaacatactttgatttgtcaacatttagtttcttaagagtttggcagtttcggaaagcataatgatttgacttagattattcgaaattgatgtttttagttaggccacgttaatgtcttgcacataggtgctcagagcatggattaatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggttgttgataattattcaaagtgtatatgtgccaccaaatgcagcaagttgttgctgaacatgcatttgatcacatcttcttatggaaataatattgaatcagaagcaaactttcagatttgatgacattaataagtctagtttgtaatgaacccttgtgataaagaatcaaatatctgctaaggacccgaaccaaaatatttccttggaacactttgcgtgacagtaataatgtcaatttgagtcagaacaggactatgcaaagatttaaggatgttggaatatgttgactttctcataactgttagagtaaaatgagatgttgcttagtgttagctactgtcctcagaaaccaaaagacaaacactaaacaaaaatattatcatattaagtctcacctcaatgataacaaactgagaatgagataacatatgtaaaagcaaggatccttaggattttattttttaaaagtcagtttatacatgtgtaagaaatattttttaatcacttagattttcaatattcataaaatacaatgtagtccagtataactgttatgatttaattataatttcagatataatttgataagagtagtatactatatagagattaatttgttttaggcattgtgtggagataccaatatttttggtcaggttaataagtttcttgtgctagataattatacattcttctttaatcacctgggctttcctttttagagtcttttttctttttccattgtcaaaaaatgttgattaaaaaaattctttaaaaaataatcactctttccagaactttattataaaattacaatctgtttatgctccaataaactgttaacaattataggtgtcatattatgtttaagtgatattaatgttaacacatgaaatatcaaaacctgaaaatttaaattttaatgtttatcacttaagtattctttttttaatgtcacccagaaaagttactttccttaagatttttaaaatcgaattttccttttgatgccctaaaattatttagagctatcaatatttgccttaaagaaatatacggacaggaacacaattcctatattgtaatggtctttcagttagactggaggaatcagttcaagaaatctattttatgtgatagtgactgtagttaataacagtgtgttgtatactcgaaatttcctaagagtgtatgtagactttaattgttcgtaccacaaaaaaatgtaagtaggcgaggcaatatatgttaattagcttgatttagccattccagtatgtatacatatttgaaaacatacaatttccatcaaaaaagcaaatgataatttttaaaaattctaatggtatatataaacatcaaataccagaaagaaaacagggaatactgaaaggaccggtgctcatagtgtctgtataagaagtatttctcatttctgtttcttcttttttctctacagtctagataaacttttaggggctataacaacagcagcagaaagaaataacagggaacgattttcaccaattgtggaaggtttagaaaatcaggaagccttgcaattacaggtgagttagttttgtcttaaattgcttctagagttatatttagagtactcattttgtatgacatcaactccattttagctggcatttaagtagtatggaatgtaaaactaaaattttttctgttgctagtttgtgagaattgcaatttgtttaaaattaggaaaaatacttttgaattattataaatgtggcagttatggctgtcattgatatttagacaagaatttagtaattaatgtaataaaccagggaaattgaagcctcagcagtaactaaggtaaaagggcaagcagttcagccaatgccattatcctaacaagtgttagtgaagtcggtgggcttgtagaaatgtaagacaattaaacacatctctctttgtgccattcagacaatattcaaaggtgtgactcaccagaatagaagggattgaattgcaattcttaggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccactttggcctcccaaagtgctgggattatattacatattttaaagattagtatattttttcccagtgttttttaataatacattgtttcttataaaatttaatcttgataaaattttatacctctactgaaaggttgaaaactgccttttttagatgactttgaaagttttgttcatgttcctgtggttgggcttacctaactaaatttcactggtttttcagatatatgtgtatgtttgtacttctcttcgaaagtttgttgagtaggaatgaactcttttatttatattcaaagttttcattacattgatatatttttaaaatcttctttaaataaatttttagctacaactctgtgagttatgtattattacctctggtttactgatcagggaattgaattggtggaaggcactccaaaatcacccagctgtgtaagggatagagctgtaatttgaacccatgtctttgtgatgccagaatttgaatacggcattgcctatactttgaagggatgcctctgccaatgagtagttcaccccaaacaatgagatgggaaagacatttgctagccttcaggaagctggacagaatggaatgataaagtgacaaattgttaacaagtaacatatggaagaatcatagatgtcttgttaagtattcaataaattgttgaatactgattatagatgcaaacatatgcagaccacaatttaaaatttcacattttaatgagctacaaaattagtaatttgttatatacaaaaactagtactctcacaagaattgtgaagtgagtttgtttatttagactatttaatgtgaatgaaaagatgtcctctaaaagttcaaaaatacatgcagaatacagaaacaaaaacccaaaagtttaaatctgttgtttaaaaaatataattagtgttgtattttaacagaatgacttttctatttctgtagtatcctgagacttcccaaaatgttattacagtctcgggaagtaattttgttaaaatacaggactaattattttttaaataacaactatatacattttcccccctttttggggttttaaaaaaggttattaacttctcacagattttttttcctagcttttaaagtgaaattttgtacctatgataggattttcattatcttcaggagttcaagaaataggtggaagataaatcgcatatcttcatacactctctcttcattgactttccttcagcttagtagcattctccggtctcttttgcaaagcacagattatacaccagcagcttcttttgatctgacttaaccttctaactagcctcttgtctctctttttcattttaaagtccatgcctctagaataatccatatttgttttctatgttttctaaattaccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaatagaagggaaagcacagattatacaccagggagtctggctatagataacgtgctttaactactaagctgtaactccttttatattaaaacttagcttatatctctttctgttaacctgatttttcctaagtcttctcttcttcctgtgtttcctattttcggttatagaggtatcatcttctacccaatctttaattttcctcaacacttctttcttttttgtcccctgcattcatcatcaagtcttattacaaagtatagtattgactgtgaatctaacccattctacttccactgcctttatcttctcccaccaatattatttcaacaatttcctaattagtacccatactgacatgttttctctccagacaataccctacactattgtcagttatctgtaaaaaatgagtccaattctaatacattatcattcttaaaaatctatgctcatgacccattgctaactttttcattgtggtcctaacttaatattctggcctttgagcctgtcattctcccaaatgtaccatatgtttgcgccatactacatttggtgtttcccagatatgctgtagacttttaaatgctctcaaacattttatcatgcggaacactttgcctgaaatacctgtatttccccacctatatctgtttcttctgtgtcttgcataagtctgggaaggcttcagtaatgaggtgatattttaactaggcctcgaaggacaagtaagcatttttcataaattatctttgctgatagagaagcagtactatggtaggatgagaggtgaaaagggcttccaggaggtaaaatagaggccagaatagtctggcagtcacttcataaaaaacagtgaggtaataccagcatccagttgaaactgctttctagatagccaggtaggaaaacctaaggtatactgagcatgaataatggtttatagaacgggaaagtagtatagttaaaatacaatgatgtactatcaaaacagccccagtcttcacaggctgctgttagtttgaaaggtgccatgtttttacaatatttcaatatatacaaagaagtggagtagcataatttaatacatttaaaaactgttttctaagatgctgaaaataataatgaactctgcacattttgtaattagatatggtacacaaaaacagagctgtaaatatgccctttcctgatgtgtgatagcttcacttacccagtcctcgcctatttaatagatttgtcctttggaatacaactgagaactaaaaaataaaacaaaaattaaataaaacaatctgagcagcctacaaatgtcaccagatctatcaagtaagcctcatggtgagaacgactttttggcctttaatgagagcctatttattctcttttcatatgttatctttacgaacccaattatctgttttacatccacagcagactagaagtgcaggttggaaggttgggagagagtttattccagaatcgtacactggaatcatcaagaagtgacaactgataagctggcagcaggggaggggtagatagaaatgtaataaaagactgaaactggaatgcaaatgataacaatagacttcacagagcgcagaggctagtagccctgcacacttcagtacctcccgagatactgagttacaccatacctcactaactcacatatttagtgatgaccctgactcaacaggaaattgttaaattatatctagtttattttgcgtaagaatgtgggaattatataattcatttcagagagtgtcccatgtgaaacaagatgttgatacttaaatagataaacagatatatggaactatcctatgtggcttgattctttccacagtggttcttgagtgttgagattttactgcaagcatacttgtaaattagccattaatgtactcagaccatcacatatgagggagtagctttggacaaagtattaatcatttgtcagtgaaagtgcatttataagaaaacaaggcatcgaggcttatgaatatggagaaaatttgtggaaattagcatttataaagtgttgaatgactgcttgatattacttaggaaacttgttctatttattgacagttttatattattgtcatttagaaaatagattactataatgggaggttgtttagagatatttgtacaatgtagtcatttttggtattgacacaaaactaacttctgacttaaagaaggatgcctttattttaaatctgtttcaacactgaataattgtcaaacctatcattttcagtaatagagggttgccagtgacctccatgatataaaaaggaacaggctgcttttgaagtcattatattagcttcctcagcactatttggcactattgatcactcctttatcaaagctccctcctcccttgacttccatgatactaaactgtattagtccattctcacattgctataaagagctacctaaggctgggtaatttataaagaaaagaggtttaattgactcacagttccacaggctgtacaggaagcatgactggggaggcctcaggaaacgtacaattgtagtgggaggcgaaggggaagcaggaggaagagagagaaggggaaggtgctgcacacttgtaaacaaccagatcttatgagaactcactgagtatcacaagaatagcaagggggaagaccgcccccatgatccagtcacctcccatcatgcccctcctccaacactgaggattacagtttgacatgagatttgagtggggatacaaatccaaaccatatcataagctctccttgtttttccttcacctatgtttcatttaaattctcttatttctatgcttgacccttaaatttgcagattcctagagcttgatcctcagtcctttggtactttgcttttctcatattgatgatccttgggcaatcgcatctatcctcacagcttcaattaactaccactcatatgtgatgtctttatctgatctcttctcttcctcccaactcacagaccccatatgttcagctgcctcctgactagatttcaaattcaatattgtccttaaatatacttatcttccttttaaaaaaaatccttctccctactctaatcctctctccagccttgacctgcatttctcttgtattcccaatcctggttgaccttagtattacctaccaattagcatatagcagaaacatactagtcatcttagaatctacccttactccatcttccattccattagtcaccagatcctatcaattctatatccttaatgttatatttcccttcctcgacatggtatccttctctctccaccctcactgccatttttaatttcagagcattgttacatctcactgttttatcctttccctatgttctattcttcattatggccccgtttaaattatcttccccaatgttgtctttctgaaatgcttttctcagaaatgcacttcagaatgcttaaagtccagcattggcttcccatagttcactgcttaaagtccaacaatggcttcccacagtctccagaattgcagtctagtcctagcccaaacaaaatacttcatctggctgttgctttctctttcgcctcatattccaccacccttctacatatgtttttagtctagtcatattgtgctttgtttcctatagattttatgctgttttatacctctaccttcatacctttgtacatgacttccgttggcttggaaagtactccacttctcaattaactcgctctgtacattcacatctttcttctctcatactttgacttaaatcatctttgttcctaactcctgctgggctaggataaagaaagaccttgttaatgtcaacagagtacttaataaggtcaagtgtggaacagtgtcaataaaattttaaatgtacaatttgtcacagataatggcaatatggataatctgtctgagaatgccctggagttgtcaattattgtaccccatagctctgtgaattgtgattaaatagatagatgtttgtatagttttcaagcctgtaagttaaagtcagtaaaaggttctagcatttttccagtaattttatgaagatatttgtgttcaaatatttccctttctctgtcacttaggtaaacaacaacaacaaaaaaacttaaatttctttttgtaatgctatgtcttatgccaataaaattggaaatttttaaatgtcattcacttactatattttaattattttatttgggacagttaagtgttacaaataaaccctaggcatatacagatgagctttgccttttgaaagtttatcatctgttttataatatttcaccctttataccataccaccccagaatgaagacaacagcatctggtgactaaagaatgtagatgattattgtagaaataaaataaattgttatagtaaaggaaggatcttaatgtggtagaaaactgataatgattcagtgtagtatataattatacatgacataaatgattggatactttatcacatgcacagaactggtagtttttaactatgtatgcttatgtattcatttaataggatatatatgcatctcatgttgaaatcttatgacatcactgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattgtttatattattgtatgtttttctaattaacctatagttttaaagctacatatccccagtatattaagcatgttgcaccagttaaattttatcatcttacccatccttaaaatcttttgttgcgagaatctataaatggagtttatgagacctttggaatgtgctggaaattatatttgtagtaaaattatatcatttatagtcatgagtttcctccttgctgtgtggccttatataaagttattctatctgctttgagcctccacttcatcatctgtaaaataaggataacagtaatactaatcttgtgtggtttttatgaagatgagattagatggtgaattatgtaaaggacctaatacattgtctaataactaataataataatggtgataatagtttgggatttcgtatttagctatgaattcaggatacacagaatgggtttgtcatgtttataattaagtagtaatatattcttccctttaagctaatttaaatttaattttgtatttgtaaatagtgacaattatttcagttttgaatttgagatatcgtttctattctctgaaaagggcagcacttgtgtaacggcataaaggaatagcaaaaatttagatgacctttttgttttccacattcatattacaatatacatatttctgtaaaagaatattattttatcagcttatgttggaaaatgacatgatagcatgtttattcatctgttatttgtaattaattaaatatctattagaatatgatatataataaatggtacattgttaagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctccagaggtcaggagttcaagatcagcctggccaacatggtgaaacccatctctactaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggagaatggtgtgaaaccaggaggcagaacttgcagtgagccgagatcccgccactgcactccagcctgggtgacagagcgagactccgtctgaaaaaaagaaaaaaaaaaaaaaagaagttgaagatgatgtcttaacatagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctctcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccaatttactgtattgttgttctcacacaactatgaagaaatacctgagactgggtaactttttttttattttattatttctttgagacggagtctcgctctgtcaccaaggctggagtgcagtggcgtgagctcagctcactgcaacctctgcctcctgggttaaaacgattctcctgcctcagcctctcgagtagccgggattacaggcacgtgtcaccatccccagctaatttttgtatttttagtagagacagggtttcgccatgttggccaggctggtcttgaactcctgacctcaggtaattcacctgcctcggtctcccaaagtgttaggattacaggcgtgagccaccgcacctggctgagactaggtaatttataaaggaaagaggtttaatttactcagttctgcagggttggggaggcctcaggaaacttccaatcatggccaaaggggaagcaaaacacatccttcttcacatcgcagtagcaaggagaagggccaagcaaaaagggaaaatccccgtataaaaccttcaggtcttgtgagagcttgctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacacatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaaatgagttacagttatatatacttagtttcattgcactaagacaagtacaataaggtatgagtactaacccataattatttagtcacatagtaatgaaacaggaaattttcccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacaattatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctcagttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgcagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtccaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagcgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagatttttcgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttcttttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccactgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagcaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaagagggatttgctagttagagaagatagtaaagggtatttccagcagagggatttatatatgcatgtaaggcactgttagagaatgatgttacaaagttgagtaagatggttcctgtttggaaggaacccttcttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccaccgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaacttcattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgtcatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcatttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggcgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggctttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttctttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatctagccttatagaaaaagttcgctgaccttctttatgttactggagcttttacatgtatgtgccatttctttctcacaacattcctatgaagcaggtgtcatcagcacatggtataaataatctaaatttcctatacttcaaacctgacgaatacatttttaatacccacattttcaaagtcctgaatccctacttacatgatatctaaaatttgtctcaactgcttttcaaagactctcctggttgattctgggagtctttgggaatggaggtgatcagaaactaatcagctaatgttctttggctttggattcttcctcttgcctatgccttctgtgagcatatagctccactctacacaaccattttttttcatctggcaactcctctgagcccttggattcctgacataatctccaaccctctcactccagttctttgtacataagttatatggctggactagataagtatggaacacataccccacccccctcaacaccattgttccatctctcgtctctagtctttatcttcccctgcaaccataaaaaattaataacacccagcacctcctgcagcaatcaccaaccatcaaattcagaattatatttcaggcaaataaggataccaagccatgtataatgagaagaaaccacagctttgagttaatattcaggaaggcacagcaaaacactttgattagggccacaaggaagaactctatgaggaatattaaagtgcggggttatgctcagcatctccacggaagttttttatctcaaattatttagtaataatatgtaggaggcaactgtgagtctcctagtctgaaaagtcctacattgtcaatttgagattatggctacaaatatttcagggtgttactttgttgagtcttactcagcaaggttaatgtacgtagcattaaactgaattgtgtgtaggatctgcaccaagctgagatggaccatatcaaatcagaaaagcctgtgtgtgatgaatgcccagactgtattctcaacaagaattgtcctattggcctagtgatactggtttttgtagcatcgcaattcctacagatatgcctttcttagtactttgtttgatgcacttagctcttggagttgattgctggactcactgattcgtgacaggaattctgacatttaaaataacaggaagttctctgaataaatgggatagccagaaaaatgtcagttcgtacttagaaagccagagacaaccagtgggtaaagtgactgacttgagcttgaataaggtaattcatataggttaaaggttaacaggaaaccaccttgacaacctcatttgtcaaatatagtcatgtaccacaaaacgatgttttggtcaacaatggaccgcttatatgatgatgattccataagattataatggagctgaaaaatcccaactgcctagtgacatgtagccattgtaacattctagtgcaatgcattactcacatgtttgtggtgatgttgttgcaaacatactgtgctgccagtaatatataagtatagcacgtacaattgtgtacagtacataatacttggtaataataaacaaccatgttactggtttatgtatttaccgtatttttcattgttattttagagtgtactcttgttaaaaaaaaaaaaagttaacagtaaaacagcctcaggcaggtctttcacatggtattccaaaagaagtcattgttatcataggaggtgacagctccatgtgtgttattgccccttgaagaccttccagtgggacaagatgtagaggtggacgacagtgatattgatgatcttgaccctgtacaggcctaggctaatgtgtgtgtttgtgtcttagtttttaacagaaaggtttaaaaagtaaaaattttaaaaaagttgaaacaggaaaacgcttacagaataaggatatagagaaaatatttttgtacagctttgcaatgtgtttgtattttaagtgtgattacaagagtcaaaagtttaaaaaaaacaaaaagtttataattactataagctaagtttaagttattattgaagaaagaacatttctgtgaatttggtgtagcctatgtgtacagcctatgtctatagtggtgtacagtaatgtcttaggccttcacattcattcaccacttactcactgactcacccagagtactgtccagttttgtaagctaccttcatgctaagtgctgtatgcagctaaaccattttttatcttttatatcataattttactgtaccatttctatgtttaaatatgtttagatatacaaataccattttgttacaattgcctacaatattcagtacagtaacatgctgtacaggtttgtagcctaggagcaataggctactaacctgtgaagtaggctataccatgtaggtttgtgtaagtgaaccgtataatgttcgcataatgacaaaatcatctaaagaagaacttctcagaatgtatccacatcattaaacaagatgtaagtgtactactttgaggtaaagaccatacttcagttttggtatttaagttaccacttcaaacaagggaaattcttccctaaaacctctaagacaactttatttgtccttcctaaaatatgcattacctgctgagttattgaggcccatttgaaaatacacaacattagctatgcacgctgttaaacataatgttctggtgacatttagcagtgttcagtaattggcttaatgaacaggtgtgcaagtatattagttatgcagatgttaatttgcagtaacatgtgcttcctgatttggggtgttcttgtataaactacaaccagtaagatttgttccttaattaggaaatcactacaaagtatgtctgtgttatccctaccattacaaccattagtcttgtttaatgtgctctgaacttcagaaacattcttagtaatgccattcctattgcttcaggtactatgcaggtgtcagaatgaaatctacctttctgtgggatgccttggttagtgtgcagctgtaggcaacatggagaggggaagcttcgcagctgtaatatgtagcatgtgcaaggagacagaaatggaatctcttcctgcctattgcatcagctttccctcctaaggtttggtgaacacatgtgttattcctcacaaaacagactcgataacaattgaacacaaaatagtggttccttacaaacagattcatctttaccagcatttttaattattcttttccatattgtttgtaattcctgtctacacttggcccttgggatttccaaggttaacagtttgtaaactataaaaatggataggaatgtttgtgagatttattcatatgatttttatttttatgtcaaaaaataggaaattacaaaggctaatttagcaaacgcccatctaccagccacccaaaatgaacacatgttaacatttagtcatatttactccaggtctttgcttttaaggaaataaaacattaaagttaaaatggaagtttccaaggttctacctattccagcattagattcctcctcttaggcaaccactgtcattaactggtgaatatctagtctatgtttttataattttgctacatatatactcatccatcaacaatacgcaagattagtctccgttttatttttaatttagatgaaaattatactgcatgtaccattttccatagctttaatttttccactcagcattgtatttggcatcaatccttgttgaaatatatagctgtaatacaatcactgtaaatgctgtgtgatattacattgtattaatatgccacaatttatccatttcataacccctgggcacatgggctgtttataacttttctactgttataaacactgttgaagtgaacatttttgtctccttgaccacttgacctacaagcagaaatgttgggctatgtttatgacaagcataccttcaaatatattagatgttgatgcatgcgttttttaagtcattgctgaatatttactgtcaaccattggcataatcaaattcttcttcgtatcttcatcaatacttggtattgtgagacttaaaaaatttttcaatttgatgactgttaatggtatttcttcagttattttcatttgcatttccctgatcactagtgaagttgagcatgttttcattactagctatatgaccttgggcatatgatcaagtttgtccttgatttcctcatttgtaaaatgacagtggttaatacctatcatataaagtggtataaaaattaatgccagatacagagcagatatgtaataaaaatttgatttttgtggtgcttgtgaagattgtattggtggttaccagtagtaaaactactactactgctgttatttttgttttttaatactctcatctgttgtgtattgcatatgtatttatctattgatctaatcttctttgccctttttttccatcaggttcatgtgatatttccagaaatgcatagataaaggtgattcagaatacagtagaaaataacaaaaaaaatcattaaacctgtcacatgcaaaaaccagagtagatttcccgtacctttcattgccattcttgcactcattttaatattatcaagtcattaattgaaattaaaatattgtatatttcaaccaatatgttaaaaaattatttccatgtagctggaatcacctctggaattgtatccacatggataaaatatgtatttaagtatatatggatcacaattcttatatttgtatgttatatgtaaaagaacaattggcatttacttgttaaatatacaaatatgtatgcgtgaagttacataaatatacaaatatgtatgcatgaagttacataaattttcagtgtgtttgttgacactactattattagctttatttaccctggctttgtatatagtgtacttttttgttagtttgttttcctgagacggagtttctctcttgttgtccaggctggaatgcagtggcgcaatcttggcacactgcaacctccgcctcccgggttcaagtgattctcctgcctcagcctcctgagtagctgggattacaggcgcccaccaccacgcccggctaattttgtattttttagtagagacaggatttcaccatattggccaggctggtctcgaactcctgacgtcaggtgatctgcccgcctcagcctcccaaagtgttgagattacacccagcctgtatgtagtgtacttaataggaagggacatccttttaattctcctcatatttcttataatatgatgcaacacataatgtgatgctgattcaaaggtatgatgttccctatatagaactatgcttgcactaagaaaatgagaatttactgagtggtatacatgtattcatctaagctatattttgtggatattttatggtacctaagctatatattttatggattctttataacatttataaagaaaattataaatgttaggtaccttttggggatacttccataattagtggtttacatatgaccatgcagtatgagtagatatttatgtgttgtgtaccattgtatgctcatgctaagctaattcatagtaggtgctcaagaaatatttggtagattaatgaatgtgattctggccatagaaatcagtctttctcactgaaattttaagataaagtagttatacaaattttactgtgattcatggttagttatcactatgtaaatcatgcaatgttgcctatttaaaatatcttaatacttgctacaaattataataacttgtcacatgttctgtgtatccactgggatatcagaaattaataggagattcctgaacattgcctatattaaattggggaaagaatataaccatgtttactttatttatgctgatgagcatttctcagttgtaaaggaatacatttatagtacaattgcttgtaaaaatccatgtattaaaggaaatataagaatactcagtgggcattttatcttagataatgagtatcttgatgttaacatatctttaataataatataaatgtcttcattattaggattatcttcctacagacagtattttataatgtttcattattattctattagcagtgccaatttacacactcaaattaattcaatatattggattcaaacccatttgcaatatgttttttcatttgtacggggaaggtctcgtttgactgtgggcctcattatgaacctgaggaccatagggcaattgatgataaaatcaattcatgaagtttttgtatcaaaacttaaaaaaactttttagtttcatccaagtaacttcaaataattatagaattgctatttatttaatgttttgtaaccattagaaacatacagaataaaagtatcctaggataagtgacattttgaggtcactatgaaagcaggcaatttttaacatatgatgtgttgaacactatagggatatttgatgtctcattgctgttctttgaattctctatttatctaagcctgtggtcatgatccctaaggaatgcttttaaaacaagaaggccaaaggcaataatagccactggtctgtaattatttatcatggcaaaaatatgattagttctgaaagcctgtctagttagagaactgttctaaacttgtttttctctagtgattctcagaaaagcagtgcccactcatggaactcttatcacttttcgaacccaggatttaagccaagttatataacacaaggaaaatatgttgagattcaagaaagaaaactatgaactatagatatttagggcatctaatcttaattttaaacaatttgttcacttgaaaaggggagaggctagaccatattttaattaaaaaatgcaaaaatataaagtcattaaatgagcattatctattcctgggttagtcaggatcctgttagtttgcagaaccatctttataggtccttcatggcacaacatgtttttcttatatgtacttggctaattagtctcccatagtgaattttaaggcatattgagatattaggaaaattttcttgactatttccttgactgggttcaaattagtgaatgattctagaagtaatttcaatatgattcagatatttcacattttatagacaaagggaatgactattggactgtcattttcttgtatacaattgtcttaagctggaactggcttgacaattagaataaattaaaatgttgattattgcatatgaaagactctatgctcttagaaagatcctttgaagaatatttgagatatgttttaatgtattttaaaacatatttggaaatatatacagataaatatcaacataaaatatattcttttaatatattttaagagaaatacattaaaagtcacttttcttccagtagtagcagtgactattatgttgaatccacatggcaaactgcttgccatgtctcataagatcataatttctaagtataattatccattctccttagactgcacataactttagattggccagtctggtaaaatttagcactgttaggagtttagttatccaggtaatttattttattaatatctggtatttctgtagcatgctcatttaatttttctgtattttgtaccattaaaacaaaggaagtcttaacggacttccagtattttgatgaattctgtagaatgttgcttccaagatggtaacatctatgaacatattgcctaagtaaaagtgtactgtggttttatgttgctttttctctaaaaaagaaaatcaataatgcatttgtggtctttttaacaaagattaggtgaattaaaataatatcattattgcctcaaaatgaagttatctttttaacattgataaagcagcagcatgattatggtcatatatgaaccagtgatgtaatttagcagcatgaatttgggggcaaggacctaacactctacttgactgaaaaagtactagctttacttttcttatattttctgatggccccattacttacaaccctgtttttatattggaaaaggtaaactgccaacacttgagtacaatggtagctgtaaaatttctataccggaggggtttggggatttaacttaatgctttattttcatagcagacagccacattgttttttgggccggcctacttggggagttggctgatggaggttatggaaggctaaagccactccttggcactgctactccttaccctttcagtcctttaaactgtttttaattatactgttaccttctaaagaaagcaaagtaaatcttctgttctaaggaagcaaatagtatttttcaaatagcgagggatacaaagctaaattactcaaaagaacacattgctgagtctgtttaattacatgtatgcaaatggtgctactgttgtacaaattgcaaatggttcataactattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatacaaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtaggatctcaattgctggttgatttctgtcaacattattcttttagattgtggagatctcatttggtcttatgtataaggtaatcatttgtctatagagtgaggattttgttttcttttggtatggctgaaggcatatagaccttttcatgaaaaaaagaaaacaaaattcttagaagtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaacatgttgatgctgttatacttttaataaaatcaaattttattttagccatctttctgggatcatatcgcatgccatatgaagacataagaaacgttattctggaggttaatgaagacatgctgagtgaggctttaattcaggtaacttggatattttccttttgaaattcattttcacagatttttttggactattctcttctcaatggagttgtaagaaaattctcttctataattagatttttaaaaagacattgaatagtttaataaaatcaggaatatctagctgtgttgatagtaaggggactcagtatagaaaatctaggttctaattctgtttctgccacttataagctatatatccgtttcagtataagcatatgcatatatagacatatcattgtccattattcactgtacatacaattacatgtacttcatcaccaaaatggctgcattaagtgtatattgttcttaccattttatgggtgaaaaacctgaggggtcaagaggttaaatagcttgctgaaaattagtgggtatttaacatacccattgttaagttgagtatctaacttttacccaactctgtttgggtacataacatgtattgctgattatggctagcactttctgtattttttatttcattgaatcctacagtaatcctatgagataagcactattattctcattttacaaataaggaaactgaggtttagagagattgcccaatttcacaaagcttgtaagtggtgtaagttgcaaagtaccagaactaggattcaaaacaatgtctgtcttgactctaaagctgttatattattctgctttccatgaacaaactgtttaatctttctaaacctctattttctcatttgaaattacagggtcattgtgaggttttaaccaaataaagtgctttgtatgataaaggactatacagagctgacacattatttgaattcttggtatgtctggccctgtctggtttaatttttgaaaggaataactgtaaagatttctgtggaagggtatagtcattgtagttttttctgtttttctttattttgttgttttttgtttttgagccatgagttggttttgagttttagaaaacatcaaatagggccaggcatggtgactcacgcctgtaatcccaacactgtgggaggctgaggcaggcagatcacgaggtcaggagatcgaggccatcctggccaacatggtgaaaccccgtctctactcaaaatacagaaaaattagctgagtgtggtggtgcgcatctgtaatcccagctactcaggaggctgaggcaggagaatcacttgaacctgggaggtggagaatgcactcagccgagcccatgccactgcactctagcctggagacagagcgagactctgtctcaaaaaaaaatgaaacaaaacaaaacaaaacaaaaacatcaaatagttaaatagcttatgctataactttaacaattttgccatattccctgcaaactctaaatctcagagaacctgcatatataatttgagcaagtgatgtctctgtggaagctcttctattttggattgtaggcttacattaaagtttacctcatatatatgtcttaaatctaggcgtgatttttaaaaataggactcaggtgtaataagatgacctatgtcatctcttccttgtttttagacctccattcccttttctaagcctttatctctttatctttttcatgtatctgtatattttacccatatcctgctttacccaccaattttgtgccttctgtttgctgaggacttttttaaagccaacttgctttccttctcagtaccagatactctgaagtttcttctcaatccttaccctgtttgatcaaaacccattttcttagttttgcttgtgggaagaaaacagtttaacatgtagtataatgtacataattggaattgtgctacttgggtacgggtgtagggcctaagtggcgagtaacttacctgagttattaaggttagtattgcttttatctagacaaatcaaatgtctgagtatcttctggtaaggaggatggatgctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaatatttcagaagtaggagaaaagggaatttgggtaaataaggaatttttaaaaaaattattaattgaaaaatcctggtggtagagacagtggttgtagccctgacacaaacaggcaaatcgggtaggggagaaaatactttcagggcaagggagaaaaattttacaaaaaacattacattggaaaatgtattggaggtcagaatagaggctgagactgaaaataaggatttttggagtcatttacaaagaagtgattgttagaatatcaggaccaatggagttcttaagtttcctcatgaaaaaagtaacaaatggaaagttaaggactgcatatctggggactatacatgtcaaggggatgggagctattagagaaatcagagcaaaaggagtcagcatatcagagagatggccaggatgctatagtgtatcatcaaagccaacacaagaggcttttaaggagtgatgaataagagaatgagattgggagaagagatatttccttcgatatgtcagattataatgacttatttagtttaaatagttatttttctatagttttttcttgaaacaatctacactatataccagacacctgtattccttaagcaactgttctgtttattcatggtattttggtctctgtctcccttataagggacatctgcattcctactgggcatgcaactgtctggtgtcctatctattgttcttcttccacttgtattgttttttgtttgtttgtttgttttgtttttgacatttccttccttcctttcttccttctctccctccctccttctttcctctcttcctgctactttctcttacattcttttcattcccttcctccctcattcccttcttccttccctcccttcctcctctcctccctcccttcttttcttccttccttcctaagtaaattctttctttgatgaaagaccttaattttccttaataatacctaaggtgaaatacagctcctggatgcctccatacctggaaactacagaaatacctccatagatgtttctctacgatgcatacatgggactatgccagcttgcttctatcccccacaatccccctcccccgccccaccaataatttctacatatattggctgttttacttttctgaagcccatttgagtaaccagcactgtactcaatgtgtggtatttataggttgctacacgattatgttttctcaaatgtgatttttatctcaaaacagattatatgatctatataacttattattggataccgacagaataatcagaatgacacgaagatcatctagtccattcccctgattccaggcaatgctacacctaagtcatcaaagatagatgggtatctattgattctgcagggaaaaaagattcttcaacttccctcaattaaccagttctagagtataattattcttatagtcaggaagctcatgcatgtgtaatagtagagctcgtttttgtctcctcaatccatctttgtaatcattgatctatttacgtggctatcgaccatctgtattttatgcaggcttgtgagtctgcatgtgtgcgtgcactttacgagggttgatgactttagaagactacaagtatgtcaattaaggctataatggcattagtattgtagaatttgaaaacatttttctcttaaataacaacttgtattcaccatgttcattttcataattctttagggaaaatgaaacagtagcaatgacagtaacaatcataaaacatttctttcttatttctcatcatggtggaataattatggcatgcttttgcagtctgaaaattcttttatctataagctgctcttctttcacatctttggctcttaaataggtgattaaaaatttttttttgtttttttcttttattgacgtttcctttgacccttgtttgctactttcagtctattattataattacacatattccaagcaaatgttatcgctgcttatttttattctctctatgtctattattgattaatgccagtattttcatttgtcaccatcaccagctgtgttgttgttcacagagaaagaaaaggtagctttaaacaattaattttttcttgtactaattggattgtgcaaaatgtttttaaaatataaaaaattgagcctatggccgggcatggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctccaaaaaaagaaaaaaaaaattggccgggcgtggtggctcatgcctgtaatcccagcacttttggaggctgaggcgggcggatcacgaagtcaggagattgagaccatcctggctaacacggtgaaaccctgtctctactaaaaatacaaaaaatcagccgggcacctgtagtcccagctactcgggagggtgaggcaggagaatggcttaaacccgggaggcggagcttgcagtgagccgagatcgcgccactgcactccagcctgggtgacagagactgtctcaaaaaaaaaaaaaaaaaaattgagcctatttacatttttagcaaaacgtaagtctcactaacagttcagtaagatgcgatctcagaaatcatattttatgctgccttggacactttaaaccatggtagaacttcattagaattttgattctttcatactatatccattgggtctattgaaattagacgatggtcagggtagaacaggaatttcctcataagtgtaaaactaggggccaggtgcagtggctcatgcttgtaatcccagcacgttgggaggccgaggagggaatatcacttgaggtcaggagtttgaaaccagcctgaccaacgtaatgaaaccccgactctactaaaaaaaaaaaaaaaaatacaaaaattagtcaggtgtgggggcgcacgcctatagtaccagctactcgggaggctgaggcaggagaatcgcttgaacctgggaggtggaggttgcagtgagccaaaatcacaccactgcactccagcctgggcgacagagcgagactccatctcaaaaacaaacaaacaaacaaacaaacaaaaacaagtgtaaaacttggtaagtggcctctttttccttatataaacttccaaaatctgaactgggaaatgaaaagcaaggttataccataacccctcctctaagtactagctgtgaggctacttccagacaaaaagcattagacacttagcctaagagattcagggtacaggagtcaaggctataatgtccttgatggaattatcagagagatagagaacaatcatgatttcctcccccagctagctccctattcattttttgtagcatacaaatttgttttaaatccaaagcttattggctagtcatatatttaacaaattatacacttttgtaattgatcatatctataaaaccactttctcttatgtactaaagaggtaatcaaaacctttccttctatacataaggaataaatctttacattctttttgcaaggttctattataattctagatatcctcctatgtaaaatagaaatgtacctagttattaaatcttttaaagacttgtgatagttatagtataatctaacataatataaaatttaacatgctatggcacactttaacatagtataataacgggtataacgtaatggtattttaactaatctctttaaaatattttaggaaggcaggaaggaatacacaagggaaatttaagtcttttaatttcttaaactcagtggtagacacgtagattcattgtctttgtatccatcttcgtgtcttaaatattacacaatgaataaatttaaaagtatttagcaagtgctgaaagcgtatgcttaaatcaggtttcctctactttggcactactgatgttttgggcccatttttctctctctctcttcttttatttttgactactgtcctgtacattataggatgtttagcagtatctgtggctctacccactggataccagtagcagctccaccaccagttgtgacaacccaaattgcctctagactttgaaaaatctctggggtgcaaaattttccctggctgagaaccattgtcttaagaattacttttatttctgaagtatatgtagtaaagtttcagaatttaatacgttcccaatcatttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctaatttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttctactcttcggcggtttatacttaaaataccactctcagtgtagtggaaaaaaaattcttttgggtttcagtcctgtattctgtatatgaccttgggcaagtcacttttcttcttttagccatatagtttttgcctttagaaggggggaaatgtatacttataaaaattggttattatacaaattaaatatgagcatatgttaaaaacccttgcaaactataaaatactacacaaattgaacacacatagagattagtatcttagacatttatttagctgtaacctgtcactctttctggccatttatctaaagagaattaacacttaaacattcaactattacttgaaagagtatcccaaaaagaactcatagtcttcatccttcccccaaatgaaggcctatatctcctggaatttttttcatcccctctctcttctttgatcccagctcatcatgcattcttactgattgaagattttctcacctcccatgcccataggactagactactattgttttctagttggtctttgtctctagacttcctccagtctagcacatcacattacttgattcgactaggcattctttttcctccatcaattcattttcattcttaagaagtgattgcaatgattgccacctgttttcttctgtttttaaatgctgtaatggatctctagaaattggagagtttctcagagtcttgattttgaataatctgtgcattacgttacttacatttgctcttctccatgcctttgcacctgtccttccatcctttaggtgtcttttttatcttttaaaatatgacttaaaacctactttctcttggaaatactccctattctgtaaactagactgaacattctctccattcttcatctgctcatttctactgtgttattcttaatcttttgaagtgatttttgaaaaagatgtttgcatgtgatgcagacattctgagctgtatcataagcattctttgtattggtcattctttttacttgttttcgaatcagatgcatgatacagagttttctttatatgataatgttatatcatgtgatttggtgatattttcaattagatattttgagcctgttaggctagtcccctctacaaggctatattgaatgggtgagcactctatattaaactgactttcagatttacagatttccctttcttgaatatttagggctgctttatctctcaaagatttctgagaattataagaaccacccaatgtcctttattgaataaaaggtcttcatgaaagtaaacataaaaattccatacaatatcaaataaatatttacataaggttttgattaacgcttcgttctaaatatttctgtcatagatgactttgaaatttcttgtgcattgagagatgaaacctatcctcatctacacagtttcccgggtttcatctgcctattttgggggctttggttcacccaagagaatactgatggtcttcattagcctaagtgcatgcagtcagtgtgttcggtacactagatccaaacagaacagccacttggttctgtttatgtaggttccatgttgtatataattttaaaaatgaaagcgtgactacttccagatgaagagattttccgtcagtgatgagtagcatcgtaaatagggaagctttgtttttggctgccctaaatccatgaggaagatttgaagtattacaaagacaacagatgctaaaacagtatgcttctcatgtgaagttgtgcttcccctttggaccggaggtgtcacaggtctagagaagagttgagcttccctaaaggagagcttgggaatgttaggcatcctccttagatcctgaaagcatgggcttatctgatcttagggccaagtctcctcagaagagccaacaggttaaatgtcatcaagagggtggactttcagaggatgagtaactagttggtggcacagtaagcagtcatatagaagtgactgcttagagtgggactacatctgaataaagccaggataaactctgctcaaccaacataaagccagtcattggaaaacaaatgtattgggtcaccatatattgtcatatatgctacttaatcattttatttttatggaatgtggcatatgttctagatcatctttacatatgatctatctcattgcatttcatttgatggtagagtggtggtagagtttgcctgatgaatgtttataaataaacacgaacacatattgctagttgggaaaataatcaattattttattttattttttttttggagacagagtcttgctctgttgcccaggctggagtgcagtggtgccatctcggctcagtgcaagctctgcctcctgggttcacgccattctcctgcctcagcctcccgagtagctgggactacaggtgcccgccaccatgcccggctaatttttttgtatttttagtagagatggagtttcaccgtgttcggcaagatggtctcgaactcctgaccttgtgatctgcccgcttcagcctcccaaagtgctgggattacaggcgtgagccaccgggcccagcccgaaaataatcaattcttaagcattggagtgaagactgttatttgctttatatctgttagaaacagtgtcccaggccaaatacacttatataggttatatgtatagataatttgaatactgcttcaaggggaaaatatttcaaacaaaactagatttgtaattgttgtaggatttctttgatttctacttgactagctcccctcagttcatggtacaaatgaatgactaagagtaagaattgttcgtgatcctctgattgtctctgatcccttttttttttttttttttttttttttttttttttttgagaaagagctctggggcagtgggctagaaaggggtgctcccctaggaaacccccaggccaccgctgcccgccacgcccgggcctaatgcccaggtgccccagggctcaccgcctctccagtccctgtccccctgatctcattctttctacactcagttgatgattctctttgtgaaaatgtatgggatgtttggaaagggtccccaaaaagccaaagcaaacccaggagtgtgtctatacattacaaaagtgaagggtcagtatctagatgatggtgaccagctgaaaaatgtccctgaatggctcatcaaaagaaatccatattgaattggatcagattaaaggaaggctaagtcccaaattgtaaaattttaaggcaacaatgtaaactctcccagagtaatcaaagactatctgagaacagaaggttgaattaagattaagaaaagggtcatttgagatacgtctctaatatttaggctgtgtgtgtacagttcaaagcatagtattaataaaatgtaaccatgggtgtgcacgttaccattactgtgaagccattgtttacccttctccccagaagaaaccactattctgaatctgaggctcatcaaccccatgcctttcttttgccatatatggatgtgccccaaaatatatgttatttagttttttcctttgtttttgttttgagacaggatattcgctctgttgcccaggctggagtgcagtggcacaatcttggctcactgcagccttgacctcccaggctcaagcgattctcctatctcagcaaccccacaactccctgctttccacctcctgttccccacttagatttactcacatatttaacttttttgtatacctttcttcttatatgacaaaacttccttctaggatcattttacttctccccaaaacaagtctgtttattttatttattttaatttattataattatttttagagacagggtctcactcagttgcctagcctggagtgcagtggtccaatcctacgtcgctgcagcatcagtcttctgagatcttctcaccttggcttcccgagcagctgggaatacaagcttactaccatgaccagcaaatttttaaaagctattttagcgatgggggtcttgctgtgttgcccaggcttgtctcaatctcctggactcaagcagtcccctatctcagactccctaatagctggaaccgaaacaagtctttttgaaagacttttagtgagattctggtcatagcaaacactgcttttgtttctctaattattttttttcacccttgttctgaaaatatattttcactgggtatataattctagcttgtcaattattttttctcagcactatgaagagattatttcaccatattctgggttcagttgttaactgagctgtagtctaaattgacattccctgggaggtaatctttctattctacctaggagtactaccaaagaataatcactttaaatataaattatcagcatatatttttacaactaggtagtttaaattctaacccaaaacttgcatggtggagggcgggggtgttgccttgtgtttagaagtttccagcagagaagccccttatctccaatcccagagtcaaggcaaaaccagacacaattctttactgttttcttctctaggcgggctttgttttttctccaaaataaccccttttctggaggtattaccttttggggttctgtaaaagctctagaccagtagagtttggtagatgttcctacgatagtcttggacttcagtgtctggttatgtgtctggattagtgctttctttttattttttttcccattggggagtttggggggcaagtaatgagaactttttaaaaatgtcttgccaagttagcttttcatctgaagatatttttaaagaagtctattcagcattttaggtgttctgtaaattgacagttcctctgggtaactaatcagctatattgctggaagcagaagtctattctaaagtatctctatgactctgttattgggaagttgagagaaacattagatattgataatctgccaccatgttcaggttagtgtatttaaagttctgcagatgacaagcgttgtttctgcttaaagaaaaaagtgttagcttgccagatgtgtcaaaatgtccagggtattatggatgctccattttgactttgtatttctttagtctaatggataacttatactttgttttcgatacaggcacctttaactagtacttaaatgaaaacagagaactaaataatgatagccgatcatcatgtatggcagtttctattataaatattttgaactaattgaagtgatttatttggtgctgtaatgataggggtcttgaatatgaggatagaattcagctttggaagcatctgcatgtactattttataataatgaatcctagcattggtttgtggcagtttgtcatggccgtgataggatgatatctaatgaaagcagaatatagcgttaacagggtatcatatatctgtcaacctattttgtctgttaaaaatctattctaggccaggcacagtggcttacacctataatcccagtgccttgggaggtggaggcaggagaattgcttgagcccaggagttcgagaccagcctgggcaacatagtgacaccctgtcactataaagagttttttaaaaatcagccaggcctggtggcataagcctgtagtcccaactgctcgggaggctgagttgggaggattgtttgagcccaggagattgagactgctgtaggtagtgattgtgctactgcactccagcctgggcaacagagtgagactgtgaaaaaaagaaaaagaaagaacgaaagagagagagagagggagggagggagggggggaaaaagaaaaccagtaaaccagttaggaaagggtaggtatatgtaaaataggtgaaggatggatatcaatcagaggaaagcacgccaaacagaaagacaagttctcaatcctgcccaaggatttaatttgcagcttggctttcaagctataaactgtcttcggcctggagttggggaattggggtttcaccaggtacccacccgcgtctgcctaagcatttggctgcctcctgttgctatcattacatttagacatgggcatacatactttggatgctgctattcaatactcatagtcattaatttattctatatgtcctactttttaatgcttaatatcactttttatgtttaatatggtttataatttttattttagagtacaaaataggacataaacaaaataaaaggtaaatagcatcaaaggagtacttttcataattatcctttatactgtaaatcataaattatgtagaaagcaatacatgtattttgcaaataggatcatgacattagtgggagtagaattttttacatataatcactattttttctattatagtagtaaatatatctgtgatcttcactgatctacttagtacagggctagaaccccttgaatagtttaattgaatttaaaataggaaatgtttagctaccgtgtaatttccctagcccagatttttggctgtggaatggaaaggaagggttgaacctgaaagagattttttttaggaaaaattgtcagaagtgtgactgaaaggtaattgccagtttgaaagcttagaagatgaaaaggatgccagttctgttggcagaatgaagccattaggagacgctgataaggtgtagggatgggtcagagtgaggatgagttctcctttagatttgttcagtttgagttaatgatgggacatctgggtgggaatgtcagttagaaacatggagcttgaggatgcctaagagtagtcagggctggagacgttcatttggcattatcagcagtgaggtgatattgatcatgggaaagtcaatgcgccttctagggaactgagtataatctgaatgttaaatgtcagagtttcaaatcatttctttaggatatgtttctctgcctgggctagattaaagattagataggaaacctttaaatccccgattatttctaagacacacttgttacttcaaggtcaggaattttctcatcgattttcaatgcttgtgtgttattttattaactaatgtgtttttgaaaatagtgactgcatgttgagggattgaaatgctccacccccaaatactttagtggtaatcagcattttaacatacttcagtatgtatgtcgattcttggagtcaaatgcaagagttttggaaatgttaggaattttatatcaaaaggagaagattgtaccatcaccacctgacagaaaatgtattttggatcaaatggaaggcaaattactcagtcatatgttgattgtgttccattgtgtaaacaagaacatacacagcccttttggccctgtcatctttatgagggcagaatctccagaggttaatgtggtggtagtcacgtggtagacatccagtatatattggcagaatggatgaataaaacagaaaataagtatagaaccaagtactggcatgaaactgtcatttcatttgaagaaaagtaaaggaacacatgatttaagaacagtaaacacatacacagtgatttaagccatataccataaaaaagttctgaaaaacatgggtaaggaattgtgttttctgaccaagcaaaatggggaaaagatgtgttatgatgatagagatttagccaagggacttttagggaaatgtttctttttcttttttttttttttttttttttttttttttttttttgagatggagtctcgctctttcacccaggctggagtgcagtggcgctatcttggctcactgcaagctctgcctcccgggttcacgccattctcctgcctcagcctcccgattagctgggactacaggtgcccgccaccgtgcctggctaattttttgtatttttagtagagacggggtttcaccgtgttagccaggatggtctcgatctcctgacctcgtgatccacctgcctcggcctcccaaagtgctgggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctgaattaattttgccagcttccatgtggcaactgtgggttcttgttttgatcctctcccctggggacaactgtgtgtgggaagaggggaggagtttcccacggggcacagctggtggtgtattgaagccttctaggtgccaagggtgtggggtgttctctggcaaagtatgggaacatgtattttttccctgctttcctttttaaatgtacttgattagaggagtaccaaagcagtgctcttcacacagttctcctctccacagtactcagacatctgaccacgttggggatgaatagtctgggcctggaatcacatccaaaaaacaactacagtgcactcagaatcaccctaactctttccaaattgcaggttttctcactggactaatcttgtctgcttgctgcttgacttctctccctttacaaaatgtctttcctgggagcccccttagtccactacacaaacagacttcaggctgattccgaggactctgtatatcagtgtcaagctgtgccttgaacccctgccttttttccatattctctgttggtatgcttttgatgagtaggtgaagtggaggtaaatgagtaccattacatctctctctcctctgtattatcttccttcctcttttatttaggaatttatgggaatgaaaaaatactcctatccaaccttatactacatctttgtctacaacgtttagtatgtacatatataaaaaatcagatatgtttaggcattgactacaaggaccacttgcaacatgagatcctacaggtaggtgactcataagagcaatatgtactattgtagtagtctgcatctgccgcacatttgagagtgagttttattctaattcgcaagtacaacttactaaacagtggcagttacataagcttaaaactcataagatgatattcagagtcagaatacatccaaggccactaaatgtgttaaatatttcatacagctgaatagagaaaagatatgtcacctcccactgtggcgccttcattctgaaaataacaggttacctatagctaggagaaaaataaaataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactcctgacctcaggtgatccacctgcctcggcctcccaaagtgctgggattacaggcatgaaccactgcacccggccactggcctcttcttaagagggaactaatcatattcgtgagggctccactcttatgacctaattgcccctcaaaggcgctgcctttaaggataatcacgttgaggattagatttcagcataaggattttggagggacacaaacattcaattcataagaatcatcaaatttgagcatgcatcagacttcatcacttttgcttgattctccattaaaaataggattgtattgtgtacttaaatatagacattgtagataatgggagatgttgtacaagccaggtgtaatttataagattgaagattattccaggttttgaaaaattatgaatggtagagttgatactttcttttttagtattattgtacctaagcaaattctacatagtatttttctgtttttagtttagattgactaattattgtgactggaaataaagcttaaaaattattctaaacacggtgaaaccccgtctctactaaaaatacaaaaaattagcccggcatggtggcgggcgcctgttatcccagctactcgtgaggctgaggcaggagaatggcatgaacctgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgatttaaagcttaaaatgtgctgttttagctgggaagaaaatcttatacatcatgtctttaaatcatcatgtagttaaattattattggaatgaattattttttcttattccacccttcatattaaggggtacaaaggatgaataagtataaattttgaattcaagattatagttatattttaagtattccccaaactgactattcaaatagttgacaaaaaacaaaaacaaaaaaatggcaggaaagagggcattatgatttatttaatttcttggagaaaaagctattttttacttaggtggtcagtgcaagtttgtttgctgtatgaataaatagttccattatggtcaccaactttaccctggctccctgaacattttccatttgcatactaaaattttaaaattaccattgaacctaatagtcaaacattttcagcgttatccaaaatattctataagcttttaaatagtataatatgttagaactgatccaatttgataccttgcagtttaaaaatcctgtttaaagtcaaactgtgctagatgggactgagcatgttccttttgaacatgtgcaataaatgctcacccatatttagagtttattaattttgagacatggcattgactgcacttatatagaaggattctgtcaaattcttgcaaagaaaatcaggaatgtatgtttgggatcagatagagcatataatggtatctgagaaaggtatttctcttatttttgaacaaggtgaattaatcaactaaattcgatagatatcatttgttaactaaaagcaatttagcacaacattgagtaatacagttatttagatcaaagtccacacttgaagcctaagctgcttggattcatattataattgaagcaagggtatataccctctgagaattcagctgtgtcatgatggttatgagttttacagtaggtatactacacaatttctctgaagccatttttttttttctgaatgcagtttatcttggaagatgtattagtttgccaagcaagtcctttcaagaggcatatccttggtaccacactgaggaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaattattaagcctaagtccgagcctgaaattagaaagtagtatgatttaaatctgtaacaatagaaattttgctaaaacatatttctctaggtgtatgctgaaattcaattcacttctgtgtgtatacatccaaacactttttaacccttaaacatatatcaacagcctaatgtgaggacagttttggaaattgtttaatagaatcatctgcagtaatgagagaggctccaaactggaaaggctcattgcctctgctcacttctcttgttaacattattagtgtatttatcacatgatttctatatggaaaacctccggtgtctccctgaatttacagaatgaagctccttcgcattctcactgtatctctgactgtcttgctttcttcctttctgctccctttggtgaagtgagtcaattggtatctttttgacattttagcctttatttcaatcagactctcactgccgttttaacagctatttcactcgctccctattctgcgtcctttcatttttccatagtggccataccatacctttccttctctcctcaagtcttctgtctcctccccattcttttaacttaccacgaacatcctaacctgttacttgccagagaaaaaagaaagcagtttgacttcaaaacctccaatatttcttctacctacaaagttttctctagctatataccttttacttattctctgtcaagcctcagaaaaagaggagctccattatcattaacattattgttgttgctattagtatggatagaaacaaaataaatattgaggacttaatttgtcagattctatgagaagcatgtttacttccaccaacttatgtattcctcatgacaaaccctacgagtttggcactattaatggctccatattaaggatgaggatgccgggcgcgttggctcatgcctgtaatcccagcactttgggaagccgaggcgggaggatcacctgaggtcaggagttccagaccagcctggccaacatggtgaaactccatctctactaaaaatacaaaaattagctgggcatggtggcgcacgcctgtagtcccagctacacaggaggctgaggcaggagaatcgcttgaacctgggaggtggaggctgcagtgagctgacatcaggccactgcactccagcctgggccacagagcaagactccgcctcaaaaaaaaagaaggatgaggaaactgggcccaaggaagactagtttacttgtccaaggttacatagtaactagtagtcacagaattcaaatgttagcagtctgaatttgtagccagtgctttaaccactgtgctcctgggttgtgggtatgtgggtgtgtatgtgatgctctaccacatgctaatcttctcacttcagttttgggcattgttatgcactgcctactttaggtggtagtatctcttgcctgctttccttctgttagttattttattacttcctcaatttgtcagtttccactctgccctgctcttcagaaaaaaagaaaatcttcagtcatttgctgcctggaaaggagtggatagatgggtggatggatgaataaaaatccttcctgactgaggtttctgcttgctactgccttctctccatttcctagcatcagtttttttcaaagatcagtctcctttttctctctgcttccttaactctcattcactgttcaaccaatggtgatcagaattctgccttaaataatgcattgaaattgaaataagaaaggcccttaaatcctgttcacatccaaaatacacatcaaatatactcacttctctgtctccatcaccaccaccttagcccaagccagaatcatcgtttcaattaaccattacaatatacatttatcttgtttttcccgctaccacttttgcccttctccaaatccgtctcggcacaacccttagtaggatgtttctagagtgtatctgtattgcatcataatttttatctgcttaaaataccagtgctgttctatagcactaaagctacagcattaacttcttaccatgacctagaagatactatctggtctggcacctgcccacctctcctactttcatcacctgctatttggcctcttgctcattatgcctcagccacattttatttttgaacttaccatgttctttcctgcttaggaccattgcacatgctgctcctttactcctgcttgctgcctccctctcttgtttatacttcaagtcatagcttaatttttgctttcccagtggtaccttcatttgcctttcagtcagaaatagatcttcctactaaactctcccagattaccttttttcttttcctttctagaaatcatcctggattttaattaaatgtttatatatgaggttacttcttgactgtctataatcccaactatattgcaagttctataaatggatgaactatgttgattttattcacgtgtgcttaacaaatatttcttgaatgcatttgcatgaatggaaaatcaagtggactctttcagtcccatcttattctgtatctatatggcatttgataacataaaagaatttaagctcctttttgaaacctttcctctccttcttaaataataaatagtatttcctgattttttttttttaagagctgcctcttaaagctcttaaagaaagttctctctgtgtcccccagggtggagtgcagtggcgagatcatacctcactgcagcctcgaactcctaggctctagtgatcctcccacctcaacctcctgagtagcaagttccaccatgcccggctaatttttttaaaaatttttctgtacacatggagtcccactgttttgcccaggttggtgttgaactcctggcctctagcaatcctcctgcttcagcctcccaaaatactgggattataggtgtgtgccaccatacctggccttatttcctgattttaatactctaaccctgtgtagtgccctatagagtttccttgattatataacttcttagatgataaaaacaaaatctcatcagttaggggtgtaaatatgccagaaattagattactcttgcagtattcattaaaataatgataatgaataattaacaaattggctggtcatggtggctcacgtctgaatcccagcactttgggaggccaatgcaggcagatcgcttgagcccaggaattcgagacctgcctggccaacatggcaaaaccccgtctctacaaaaaatacaaaaattagccaagcatggtgctgtgcttgtccagctacttgggaggctgaggtgggagaatagcttgagctcgggaggcagaggttacagtgagccgagattgcaccactgcactccagcctgggcaacagaaccagaacctgtctcaggaacaaaaccaacaacaaaaaaacacaataaaattgacaaaactgggggaaattgtgaaagaaagaaacttatctaaggcagtgactgggacactaagctttctctaaccttttgggtttttttagcagccacatcattaggtttgcttataatcatgtgcaaccagttggaaaaaagagaaaaaaaaagaaatagaaaaacccagagacttttcctctgtctagagacagatcctggtaagggggacatgctcgctcccacatattgtatgatcaataatcttgtttagggggtagattggctgcatagcttcccactgacttgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaaccacctgaaaattgaatattcaaattaggtcagtaggtgtcaattaattttgctattgattggttttcattaaattttttaaaaatcaaaagttaaccctttcatttttcccctccacatatcactaattcctaacaccaccatagaaatttttatggctgtgtccaggcatggtggctcatgcctgtaatcccaacactttgagaggctgaggcgggtggatcacgagatcaggagttcgagaccagccttaccaacatggtgaagccccgtctctactaaaaatacaaaaattagccaggcatggtggcgggtgcctgtaattccagttactcaggaggctgaggcaggagaatcgtttgaacgtgagaggcggagggtgcagtgagccaagattgtgccactgcactccaacctggatgacagagcaagactccatctcaaaaaaaaagaaatgttgatggctgttcttggcctcaaacatgttttcagaaaggtgttttaaaattcttgcctaactttttagtgtgattcttctgagtttatagtgccttttgggacacacaatgttattgtattctgttctagactaaagacaagtgaatggttgttgatgggtagtttccacatatttttatctttggggaaatattctctaccagtacatcattatttttcttttttctttttctttttcttttttttctgagatggagtcttgctctgtctcggcctcccaaagtgctgggattacaggcgtgagccactgcacccagcctacatcattatttttctgatgtagaatcagttttcaacactcaattttttcaaggcttcaattcacagattaagtatggcccttttctctcatgacatctaatgtacgaacatttggcattgactccatatagttggtacacttgtattgattattttttccaggcctggtactggatttgctacagaaagtattagaatgagtataagtaggagaggttctgccctggaggaggttgttgtctcaaagaagataacagtctttactttataaggtgtcataaatgcccctgccttatttccacaactccaggcagaaatctggtcagtattgactcaatctcatttctgtaggcagttctgccttctattaaacttaagtccattctcctttaatgtggtttcatgatcattctttttgttatagtcacagatacaaaaggattctgtatattcaatgggcaatggatcaaaagagtaactatttggaaaaaataccttgtagcaaatatatatttgttacaaatttttctgttaattctaatgaattcttaacattatattttgaagagacggggggatcagtttttctcccatatgttaggccttaatggaatatgtcttagaagtgaaaaggaaagatgatagaaataaccctaaaggccacacctgaccataggagtgccatgtggccatctccttttccgtcacatatgatttttacatttgtgctcttttcctttctcggtggattcgtaggttagttgggtagtagatcaatattcatgagctgcgtaggtactgaagtgtgtaaaattcaaattatataaacaaaactgtgtctaactctttggggaaataacccacttgtagttgctctcactaaagctgtcaatgcacttcttttatttttttttaatatagtgaagatcagctaaagaaatgagagccacttgatgtgatttgatagacaagtacatcgtaacacaaataaatcccctacataatacaataccctggtcagcatcccacagcacttcaaggaatgaattataaaacaaaggatgccagtcaactaaaatgctgcaagggaccacaactaaatacaaacacaaatttcagcagagtttttattttatttacttatatcacttaggtgcactcaagtgcctttatgagacatgagccttttaataattgtatctgtggctggggatgttgctcagtgcttcctactatttctaagcttagttatctaggacatttccttccatatccaaatcctctgatggagttgcaactgtttctatcagtgtacactggtctgatcgtaaaaattcacacttatggttgcaaaaattctgtggttatgatcaatatgtactggtttgtggcttttgttaagagatgcacatgtatagcttgcctcctacatcatctcttgattttgtaataatacaattttaataatgacatttctaatagtagatgtatattatgaattaaaaatagctaaataaagcatgatatttacagtggataatgagagctgttcttcactgagccctggaaatatatttcttaattttgaatgagagaaattttacgttgggtttgggggaaaagataaggaccccggtttcttcatactgacaatttctgaagatgaataaagaatgtaataacaacaagaactattgttttagggtgtttacatcatgtcagttactatgacaggagtgatacacatagtatcacatttaagttctaatgcatcgtgtatagatgatttaatgaatacattttcatgatgaggaagtaacttagaaactccaggtaacttgcagtaggtcatacaactagaaagtgaggcccagtgaggtcacttacatctgaaatcccagcactttggaaggcccaggtgggcagatcgcttgagccccaggagttcaagaccagcctgggcaacatggcacaaccccatctctgcaaaaaaatacaaaacttagccaggcatggtgacatgtgcctgtagtcctggctactcgggaggctgaggtgggaagatcgcctgagccccgggaagtcaaggttgcagtgagctgtgatcaccctacagcactccagcttgggcaacagagtgagaccctgtctctaaaaagtaaagtgacagaagtgtggctcaaacctatgtctgtgtaactacagtgtcgctgtttctcctactgcagcttacagtatgggtctggagaatgcagataattgtttccccctctttcctgggtttagagaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaaggattggtattattataaataacattgtgtttactgtgacttgaatatcacttcaagatttggggtcttgaatgggaaaataagagcatcattgttagaagtaagatgccctatttgccgggtgcagtggctcatgcctgtaatcccagcactttgggaggctgaggcgggtggatcacaaggtcaggagatcgagaccatcttggctaacacggtgaaaccccgtctctactaaaaatataaaaaattagccgggcatggtggcggctgcctgtagtcccagctactcgggaggctgaggcaggaaaatggcgtgaagccaggagacagaggttgcagtgagccaggattgtgccactgcactgtagcctgggcgacagaacgagactccgtctcaaaaaaaacaaacaaaaaaaaaaagatgccctatttgatgtctgagaagatggtcagctgaatttacttaaatgctaatacaaatttttcgtagcagccaagcaatacttttcctttatggaactagtgctttttactctaccttcccacagctgtagaggcagagcctaaaaaagaagaaagtaaacgtatggatcatttattttgactcccttcttttcatcaaaacaagaccgctttacaggaatttctcccactttacgatggggaaactaagaccagaaaattaggcagactgttttcacacagtcagctcacatgacagtttctaaattcagtctcatttgacttagttgctgctaagctacacctacctgcccctgctgccttagtccctgattggcttactggaatttaagtagcagcaggtcagggaaagcaaatccatctactctcattctctgaaacaagcaaacaaccaggtgacaaactgtaccaaattagcacatccttctaccttcattattgccggcagacttcaaactttggagccatctttgactttctcctgctataactggtcggttactaagtcccatttattcttccttaattctatcttttatatccattgttttctttatcttcctactgtcaacatgctacctcattacctgtttcttacaccattttgctaacttcctgatggtctccctgccattaatctctccttcaaccaatcatacttactgctcctaataagactcaagaggcagtgtggggtagcggttgagagtctggggtctgtagcccaaaggcctgcattcaaatcttcaggtttccaacataaaatttgattttgtgcaagttacttactatttgtttcacttttctcatctttggaatgaaaataacgataaccgtttcctaggattgttttgagaatcaaatcagttaatatataaagcaaatgttgaaaaatgtctggcacaaagtacttaataagtgttaattgctgttagcattgttaccatcattatcaaagcatactttggttatgtaatttcaattggagctgatatttttataaaaatatcaaatccatgttctctgagtttgtaggccaaacattgtaggttaatacaaaacatggaaaggataagaatatgattgcaggcacatgatattgggaccaaagaagactaaaagcccacatatgcctaagggttttgttccttgtccatctgggaccaagggcaccctggtgaacatggcccctataagctctgcaaagtatggccaggagagcaagtgcatggtcactagtagctgctcaaagtagctctatagcttttttagtcatcagggagactaaaaaactactccctaaacgtaaaatgatagaaaacctgcttcagtgctagtgatggccagttaccagtaaaaggaaaggaaaaataaagtggggagggatttggagacagaggtagaggcagaaatgaaggcagaaaaatatatagagaaactcagagtgattcccacacaaacatacacaaagagacctgcaaattcacggagacatagactttgatgcgattagcttccacttctgcggcctttacctggactctttagatacattgtttccaattctacccctaggtatgtatgtcatatatacctagcctataaaccttttctcacaccattctctctctctttacttttctcacaccattctctctctttactccctccttccttccttctttccctttctttcttttttttttttttttttttttttttttttgagacagggtctcactctgtcgcccaggctggagtgcagtggcacaatctcggctcactgcaacctccgcctaccaggctcaagcgattctcctgcctcagcctcctgggtagctgggattacaggcactgtgccaccaccaccatgctaatttttgtatttttagtagagacagggtttcgccacgttggccaggctggtctcaaactcctgacctcaagtgatcctcctgcctctgcctcccaaagtgctaggtttacaggcctcagccaccgcgcccggccactttttccttttagtgtcagttctatgtgtgcttaaatttacacatgcatgcacacacctatacatatattttttcatgtgtatttcctctactgtgaagccttcattaatcactgtaatcataagagtttaaagttttttcttcttccagtgaacacctccagaacttaatttctttttacctatctaaaatcatgtgctggctttttcaccagcaatagttttcaaggttctatgttgagtttcagactatattgtaagctttttgtgaataggtggcgtgttttatagttgccatgtgagtactgaagaaatagcagtacaatttgtataataataccctgaccagataaaaaaaagtgagtcataagtgatgagacctacaaaaatacagtaacaggtagatatttcatcatacttttgtatatctgcctgtgaaaagcatgaaagcatataggaggattagtagaaggcagaggttcatatttggagaggcagatgttcatggttaatgggcaaattcgaagaagaaaaataatgggctatgtcttgattctgtattagagtagatatggtctgcccaacagctcatctgctgcttttgaaaggtactttgtggtttaaaaacttttgtttatgtcgtcaaattctcttcatgttatctgcagatatgttggtgtctaatctgtacttggcatttgtatttaaggaagtaggctatatatacaaaaccaaatataattaggaatgttaataatttattttcactgtgtgcatgtgtctgtgtgcgttcatgtgtgtctacctctccccgacctccctcccagaattcattttgtgaaggaaaactagttgagtaacttggagctataggaaattaaaaactaaaacaattattatcatagtaactataccaagtggaatatttaatgtgcaccagtgctatgaaacaagtaattaaaaccaaagttgaactgtattgaagaaaaccaatgtagaattcttgcataatgtacttgaaagtaagttcatgtgattttactatcatctaattacttaacagcagcatctgtcaagtaggtgaaattctttagaaattctttagagtatatataaatagtatattttatgaatagaaatcataagtttaaaaattattaaatgctcaatcagagctagtcttctgatttcaaacagcatagtaataggtaatttcttaggaaatgttccagttatattttctgtcatcatgtacatcttttatctgcggcccaactattcactcaactcaatttcatgtttataaattttcctagttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtcgcttgaacacgggaggcgggggttggagtgagccgagatcatgccactgtactccagcctaagcaacagagcaagactctgtctcaaaaaataaaatataaaataaaatagatgcagtattatatttcctttacattattacttatatcgttctaaaaagtatctgacaagctaaatttaatgagataaatagccagaaatttatttttgaatatagtttgcttattctactctaagataataatactcttcaatgtcaagtagtgttgtacactggtatctggtgcattaactaagaggtaaaaaagaaaattgaataacaatcatcttgttttgattggatcatttaataatatttttgagacttatgaaaagcaaacaaagaaacagagaagcccaaaagtgcttgtatatgtccatttttaggctagagcaaaccaccttattcaaagaaaagatctgtctgttatagaagcctgaaaacactctgaggtgaaggcctgtaagaaagctagagacgaaaataaatctgaaaacaagcaatctgtctttgacaactcaccattctttcactcttttttttctctcacatctgaaaatattgcagaactttggttagttcttgaagtatattataatgagaatcccaaatctagcaatggatatgaatttcttttctatacatgcattaaattgatgttcattacatatacatggactagcactttgatatgtatcaaaaatgatttgatcttggtagttctaacccaaatagacataaagaataacacttatagataataataggatgtacaatagaattgtgaacatctgtttactcctgatatatttttgagggctgtaaggaaagagaacaaggaaaatacagaagattatctggaaatgctggattttgtgaagaaaacatttttacccccatcttcttgtgatatttggggacatgtaaaatcatttcataatgccagagggaataaggcagtgcttgtaataaactgtactaaatcatgccagatttataggatgaaataaagtatttaggacttcagcattgtattgcataccatatccccaatgttaatagagtcatctctaccatggtgctacttgcctagagtatatgctatatgcacactgagtgaatctaaaagtgttcttgcttgacaattataaagagattataagttaaaatatcatcagaaatttgtattagatacctattttgcatttaattcatataaaaatatttaaaaccattctaatttgaagaaatatgtaccttataagtgtcttaatttcacactattcaaattaattacatgaactgatttctttgaagcaagaatgaataagtcatttatacataggaacaaaaggttacgttaatctcaccgaaggattttacagttacatcttatattttggagagaggcttctttctgtcatctacctgtcaaataaaagttcttctacacaacgctgatctgacatctatcactagaggtatgctcaaaggattcagcacaaagatttttgccaacttcaaataaaataaaaaataatcttgcgggaaatactatcatgtagcaataggtgttccaaaagtgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcattgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtgactctgcctgattcaagcaaaaagtgaaacttgctggaaggatatgaagtaactaagccagaaactgaggaaagactaaagaacttgccctttaaaagaacagcaactgtgacagctttgagaattcaggtagcaggaatgaatgaaaagtctttttaggatgttgcctttgggatatatcagctccaaccattttccttctcctttccctatgtttgattcaaattcaaattatgaagagagcctaatgagcccggtgtggattataagaacaccccttgttcaagggagagcaaaaaaccctgattgacagtgctaccaaaactacctgccatggaagattggttatgccctaaagggtgctgttaccaaagatagggctaccaaaggttaggagcaggtaaagggatatcaggcagctctaaacaaatacaaaataaaacagatgatctattcatcagaggcctaccaacaatagagaagatacacagaaacctcaagaagcttgtggtacagttgagcagccaggaaatatacatacacaatattatgtaatgtcacaaggtacactgtcaatgagggcaaaaataaatggccactgagattagcagtagttcaggggaggaaggaatctttggtgattgggcagtgctggtaaattgaaaaagaagaatcttgaaggataggtaggattaagaatctataactttacaaaaggggagaacattgtggcttggaacctacgttttaacttacacttttgtcaattactagccaaattttcctgactaagtcacttaccttctctaaatctcaatttgagattgaatatttcttgaatatttctcccttcacttcttgtatctttttttggatttccttgcattgggcttcacctttctctggtgcctccctgattagcgtaataaccaacatcctgaattctttttcaggtaaatcagggattttttttcttggtttggatctcttgctggtgagctagtgtgatttttgggggggtgttaaggaaccttgtttggtcctattaccagagttggttttctggttccttctcatttgggtaggctctgtcagagggaaaatctagggctgaaggctgttgttcagattcttttgtcccatggggtattctcttgatgtagtactctcctccttttcctatggatgtggcttcctgagagccgagctgcaggagctgcagtgattgttgtctctcttctggggtctaggcacctggctctgggctggtactgggggttatctgcacaaaggcctgtgatgtgaaccatctatgggcctctcagctgtagataccagcacctgttctggtggaggtggcaggggggtgaaatggactctgtaagggttcttagctttggtggtttaatgttctatttttgtgctggttggcctcctgccgggaggtggtgatttccatagagcatcagctgtggtagtatggagaggaaccggcggtgggcagggccctagaactcccaagagtatgtcccctttgtcttcagctaccagcatgggtagggaagggccatcaggtggggcaggtctaggcatgtctgacctcagactctccttgggtgggtcttgttgcggctgctgagcgtgagattcccagctcaatggagttgtgtacctaccgtggattatggttgcctctgctgagtcatgcaggttgtcaggaaagtgggggaaagccggcagtcacaggcctcacccagctcccacgcaatccaaagggctggccccactcccaccatgcccccactaacagcaacgagtctgtttccaggcagtgggcaaacagggctgagaacttgccccaggctacccacctccgagctgtgaaagaaaagggctttagttcttcccctgcctgtagagtctacacagcggattcacgccctccactgagttctggccaggaggcttcttgaccacttcaagttgttacaaagatcagctggagactttcttctccttgtggcttttccccttgtgcctctggctgccctccggaaggatccctatggtgccaggcaggaatagcctgcttggggacccagcgaactcccagggcctttcctgctgcttcctctacccctgtattttgcttggctctctaaattgactcagctccaggtaaggttggaaacttctccctcaaactagaccttcggtttccccagtaggggtgtgtgttcggtggtggaggatctccctttcccacttcgcaatttgggcactcacagtatttgggtcctgcagcagcagtccccttccttcagagggtctgtgggtcctctcgggattcctggtttatccctgcagtcgttttggagctaaaattcacaacgcaagcctccgcacgcttctctgtccatccgagttggagctgcaatctagtcctgcttcccgtctgccatgatcctcccacaaattcataaactttcttaaaacattatgagagttttttgtgggtttttttttttttttttttttttagctcatcagctatcattagtgatagtatatactatatatagcccaagacaattctccttcttctaatgtggcccagggaagccaaaagattggacacccatgatctagaatatctataacatgtaaagcctcatctagaggccattacatggtattagtgacaaagtatcataccaactatacaaaggaaacatccatctccatccatttcccccatagaagttgttagaaggaaagtaaaataggttcagctttattgtgaaatagaaaattactgcagaaaatatgctttgtaaagaaaagtgactgctgtctatggtagtaaaatttggaaatctgtaatccacacacacaaaagaatctacaaaagaccttagaaaaaagtcatatgtaagtacacgcaaagttttgcagtgtctaatcatttctagctaaaataatgtggactatgtccatataaactcagaatgtcagcatatgaatacatccagtctaacctcttcagtccacaagtgagaaaactgatgcttgtagaagcaaaatactttagtcagtgtattgttcagcttggactgacataacagaaaccaaaggctgagtggcttaaagaggagaaatttattttttcacagttataggactgaaagcctaagatcaagatgccagcagggttggtttctggtgaggtctctctccttgggttaccatatggccaccttttcaccgtgtctttacttgacatttaatttactgttttcttcccctttgtccttcacaagactcagaactcgtcaaatttggatgtatattttattctgcattatatctccagtgtctattatatgtgaagctctcaatatattactacagattgaaagtcagacaatttgattaaatagaggatttgttattaatactcagcatgtgttaacttgttttttaagttagaacattttgttcctcacagatacaaagggcatatttttgccagcaaaactgttgaatatgtaactgtaagattttttatgctttatttgtaaagacgcaaaaatgtgttgtttgctgtaaatctaaatcagcaactcattattaaatatgggttattaaataaattaacatgagactattaatttaaaaccaaagatattttagaaaataatcactataggatgtactgaaagggaacctagcaacgatcaataaatcctggtcaacagtccatgcatttgtttgcctgtgtttttatagtttataaagtgttttccttgtgattcagggaggttaagtattattgaccccattttgcaaattagaaaactaaagcccagtgaggttatataatttgtccaagattcaaaaactagtaaaggtacaagttggggcttacatacaggttttctgtttacaaaattgtgtagcaccctgcctcttattgcattgtaacaatgtttggttatacttggctcatttcaaggaagcattatagaaccaactctggcacttacagtattctgaaaatggggaaaacctcatgtgaattttcttggctctctggcatgaaacttggaatccatcttttttattttaattcagcttggtgtaactgtaggcctatcaataggaagtttctcatcttgtaatagattttaatgtatccaagcagcagagcctatatatttgtaataaaatagcatctaataatttgaataattgtggagctatcccttggtgttgtatagactgtcagagtattttagttttgtgtaggcaaggttgactgctgttttcaatattttacaaatgaggatctgctctccagagagatgatctttacccaagatcacttagtgatgaaggcagagttaggatccagcttttcctgggactcaaacaaatgatttcagtggatcatgctattttcagaattttcattgactcttttgcttcactgaaatatactttttcctatcagacaatatttagcattaattgaatttgagggagatgtggttgataatttgctgagaagaaaatgactttgtgggttataatttgtcttgaaaaaaattatgtgaaagggaagattagactctcgatcatttatggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaatacgctactgtgtgctttgaagattgtccttcaattagcaagtcagtgctttatcccacttctaagatgtcagctacctggtctccttgtgtgtctatatagtatagtggtgcacatacagattgactacttaagtagaaagaaaacttgatgaaggtaatatgtgtctctgtcttatgaggtgccatcttctaaaatgatagcctcaatttttccaaatggtcatacatcttctagatttatattaatgtggagatgcatgatatctttcttgttctctgtagcctacattaagaaattgaaatgagacaaaacactaactttgtggtaagctaattacagcagagggaaaaatatatgatcatgtcaggcataggaattaacaaagtttatagatgtattttaaaaattgctatagttctaaaagcttatgtgtctcaaaatatctttttgaaaacttgagctctgagtgaaagaaactaactcacacctttattctcctccttgcctcttaaaatatagaggtcccgtgagcttatttaaagatctttttctctaagttgaaatattcattaatttacattcattgctgcaaattagctagtactttaagtgtaacacttgtttgttttctcagaatttgattacatctgtttagacaaaatcatcacatttacaatactataggttgtgtgaaaacttgattatactccaaaattttcagtttgttaaattctctagagaacaatagtttgtaaatgtaatttgtctgatgcagacttgattagtattccttgtcaatactgactgctttggagactcatgggatttttttctattattcttatgtatgttaaaattttctgttgcctattacacacacacacacctccctttacctgtgattattaatatcgtgaagcctatgctgctatctctgattttaacttatatgttacagttatgtctgcctcctagatatctagataacttgctgtgaggtgtatatatgtatatacatgggacatacttgccttgagtactagtaatgcctcgttattatacacccctctgcaaacacatgacctttttgttatggaagagttttcaacttttgaaagttttgtattaggggaaggaccaaggaaaataaaataagagccagatgaagccaaaaagggtgtgtgtgcatatgggtgttgagtaagagagacagggagatagacagagacagagagattgagacacagaatgagagaaagataatgaaagagtgagaagggttggggtgattttcacaattggataatcagagagaaacaggattgagttaaatgttcctttgtatacatcaattgactcataaagagcattgaaaaatgcaaactggccgggcgcggtggctcacgcctgtaatcccagcactttgggaggccgaggcgggtggatcacgaggtcaggagttcaagaccagcctggccaagatggtgaaatcccgtctttactaaaaatacaaaaattagccgggcgtggtggcgggcacctgtaatcccagctacttggcaggctgaggcagagaattgcttgaacccgggaggcagaggttgcagtgagccaagatcatgccactgcactccagcctgggtgacagagagtgactccgtctcaaaaaaaaaaaaaaaaaaaaaaaaaaaagaatgcaaactaagaattaccaaattatattccttatcttctaccaataataagcattaaaaagtcaaccatatatatttgtgtatagaactgtaatgaagggtataatttgttttctgtagagaactcacctgtggcttagtttttgactcattaaatacagatacattttcaggaaataagaaaattaatgcatctgtattttctttcattttaaaaaaattatccttatagagtaatacaaaaaaagtaatcaaattaatgctgtgtcacagctatacttgttgaagtcgttgtgactaaacaataatagatacagttaatggttgaatagtataactggcagagatgaatactcctctagttaacaaaaatacattttttttgttcttgatgaataccccatatatcaggagcagcaataagcattttcagcgctagagcagacaaaaaatgatgatttatggaactagctgtaggtcttacttagttcgccatgaagactgttttcatagaggatttaaatgaacccagctggcttcgtattctgtgaattgctatagtcgttttctgagtataatcttatgactgattttgtaattctcacagtaggggaaagttgacaacatgaatggcatttagtgaatataattagtaagtctgaaaacaaaggcttttttattctataaaagctctgttcgaaggagattttgaccctgtatgagactgttccaaaaacatagctaccatgactaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggatgcaagtaacctactatgaggaaatataagcttttcagaggctatttagggaaaggatctcaatatttcagatttaagcaactagctagatacacatattaaaacagaatcctctacttagaaacctgtgctgagggaagtggaaaagtattgtaagttatattcaaagacttggggacagatgaacatgcttgattccaaggatatttcatcaatcacagcctggcccattcagatcactttatgcttccaaatttcagctttcaaaaagtgtacgagaaaggctagggttactcgttgatttcttaaagcatcttcttaggactttgtttgttgtattgttattttgttagaagtaaaatgtattcatggccaagagagacttgaacctaacctataatttcttgtagtaactttactgaggtttttaactgacatactataaaatttactcattttaggccaggtgcggtggctcacgccaataatcccagaactttgggaggctaagtcaggcagatcacttgagctcaggagttcgagactggcctaggcaacatggcgaaaccccatctctaccaaaaatagaaaagattagctgagtggggtggtgcgtgcttgtggtcccagctacttgggaggctgaggtgggaggattgcttgagcttgggaggtggaggttgcagtgagccaagatcgcgccactacactccgcctcagagacagagtgagactgttacaagaaaggggtcctgatccagaccccaagagagggttcttggatctcgcacaagaaagaattcagggtgagtctgcagtgcaaagtgaaagaaagtttattaagaaagtaaaagaataaaaaatggctactccatagacagaacagccctgagggctgctggttgcccatttttatggttatttcccgatgatatgctgaacaaggggtggattattcatgcatcccctttttagaccgtataggataacttcctgacattgccatgacatttgtaaattgtcatggcgctggtgggagtgtagcagtgaggacaaccaaaagtcactctcatcgccattttggttttggtgggttttggccggctcctttactgcaacctgctttatcagcaaggtccttatgacctgtattttgtgctcacctcctatctcacctgtgatttcgaatgccttaaccatctgggaatgcaacccagtaggtttcagcctaattttacccagctcctatttaagatggagttgctctggttcacatgcctctgacaagaccccatcttaacaaaaaatttactcactttaggcatacagttagatgaactttgttgtttgtatacagctttggaacctccactgcaatcaaccagtgtggtttcctcatgcccctgtgcagtggatccccactcctagctcgagacaactgctgatttgttttaaatcaccatggtttcgccttcttctagaatttcatatgaatggaatcatacagtaatagagcctttgtgttactttgtgttgttagtgacttttttcacttagtgtaaagttgtggcatgtattggtagttcatttttattttgaggtagtattccattgtatggctgtgccacattttgttcatctgttcatcagctgatggacagttgggttgtttctaaattttctattatacttgttgctatcatcatttatgtataagacataaattcatttatcttgggtaaatacctaggagtgggaatcctgggtcatatggaaagtatagttttaattttaagagagactgtttttcaaagtgtctataccatcttttcttttcttttcttttcttttcttttcttttcttttcttttcttttcttttctttcttttcttttcttttctttcttttcttttctttcctctttcttgtcttgctctgtcacccaggctagagtgtagtggtgcaatctgagctcactgcatcctctgcctcctgggttcaagcaattatcctgcctcagcctcccgagtagctgagactacaggtgcacaccaccgtgcccagctaatttttgtatttttagtagagatgaggtttcaccatatagggcagggtggtctcgaactcctgaccgcgtgatccacccacctcggcctcccagagtgctgggattacaggcatgagccgctgtgcctggccatctaccatttttcattcatacttatgattaaattaaaccacaatgatggatttcatatttggaatatatgaatatatatgaaaagatatctcatattcatgagactggcaaaaaatgttaaattctgttaatataaagtagaggtaagaataaggggcaaagagaactaatggtgagagtataacttgctaaattcattttggaaaacaatttggtactatcaagaaatgttaaaccatgcacagaaatgccccttctagtgtatacactagataaactcttaggtaaggaccctggagacatatacaagaatgatcacataatcaaataacactatcaacagagtgaaaaaaaggcaacccacagaatgggagaatgtattcgtaaataatatatttgataagtgattgatatccgtaatatataaagaactcccacaactcaaccacaacaaaacaactcagttcaaaaatgggtaaacaaattgaataaatatttctccagagaagataaacagatggccaataaacacaggaaaagatacttaacaccactaatcattaggaaattgcaaatcaaaaccacaatgaaataccacttcaaacatactataatggctactatcaagaaaacagaaagcaacaagtgttggcaaggatgtggagaaatttgaacccttatgcattgctggtgggaatgtaaaatggtgcagccaatgtaggaaatagcatggcagttactacaaaaattaaatggaattaccatatgatccagcaattccacttctgggcatatacataaaagaatcggaagcagggactacagatgattgcataccaaattcatagcagcattattcatagtagccaaaacatggaaacaacccaaatgtccattgagtgatgaatggataaacaaagtgtggcatatatacaatggaatactgttcagcctttaaaaggaatgaaactctggtatatgttatattataatatgaatgaatctccgtgatgttatgctacatgaaataagccatatgaagaaggacaaatactatatattccacttatatgaggtacctagaatagtcaaatttgtagagacaaaaagtctttgtttaccaagggttgggggataaggcagatggggagttaatgtttaatgggtaacagtttcagtataggatgattaaaacgtcctggagatggatagtggtgatggttgcacaacagtgtgaatgcacttaacctcactgaactgtgtgcttaaacatggttaaaggcaagcatggtagcccacacctataatcccagggctttaggagactgaggcaggattgcttgaagccaggagtttgatagcagcccagataatatagcctgtaatctcagcactttgagaggccgaggtgggcgaatcacttgagcccaggattttgagaccagcctgagcaacatggcaaaaccccatctctacagaaaaatacaaaaattagcacggtatggtcgtgggtgcctgtagtcacagctactcgggaggctgaggtacaaggattacctgagcctgggaggttgaggctgcagtgagctgtgatcatgccactgcactccagcctaggttacagtaaaatcctctctcaaaaaaataaataaataaataaaaaagtgttcacagcagcattatctgtaattatatccaaaacagtgattccctcacaaaaaaaaatggaaaccagatattgaaaatgttcgatgagataatatgcctaaaatttataatatttatatggtcaactaatatacagcatggatgaatatagctagaaacatcaacatggttaaatacctcactcttaaacagctgctcttcagtgctgaattctaattacgcttttgtaatattctgtgtcttagaccttcaaagtttttcataaatagctaaaatcactaatgttaagtgccatttaatgccatttattaaaggttaaaacctttaaatgcgatttattatttatctacagtgtatagacagagcgaatgagtcctatggactcttttggtgctagtgacaatctgaagctatgtacataaaaaaaaatattccatctactctcaaacctcatacatataaaacaatttaagtaaaatgctcatgacaataaaagttaaaagttttagttacgtgcttaacccatgtctgagaagaaaccatctaacaccaacaaacattcatacttgtaaactatttctataccaatttaaataatttgatttttattaaaactattctcagaagaatttttatttggtaagccaactatagacaggatgattaaaagcatatgaaagtaccagaacagcttttctttgcatagatatatttcattaattcattctggcctttcctaaaaccagtgagtacaaatgatggttaatttgccactggtcctggcaatgcaggctaatgcacatgcaggtcattctccttggataagtggggctagaagggaaaatgctgagaaggggagcaggaaggacaggaaacagaatttgtcttgtctaagaaacttagcagcacaaatgccctgctggtccggaaggtggcaattgagatgaatccttattccatttaatgttgttacggtttcaagtttcagctctcctttcacagattgctaccataaattaggctaacaagtgtgaaacttttaatttgcttgactatacaattgatattatctgtttccttttggttggaaatatcattataataccaaactaaagggtgtaaaaaagggactatcaggcctacataaaggatgaagacctctttccaccgtaaattacatttggctgaattagtgtcagccctagtcatgtagtgcccagaaaagcatttttggtgacagatttagaaataaagctgggaaaacatgtattaaacctgtccggtcatagctacagaactaatgtctttatggtaattgcaatctttaaaaatacattatctttttcaatgttactgcagtgtgtggtggtattaaagaaagcaataatttgtaaacaacccttggcagagggcacagaacttaattttgtttaaataaaggagactaacattagaattcttgtgctgtatcaagactgacaagcagtagtagctgttttgatatgtgcactggagcattcatgattgcttaaatattaactgttccatgaatatacaaatataatagggaaaaaggaagccatgattaatgaaaattttcactaaaagaaataaagttgaattatatgactgtactggtggtttagatggttttattccattgactcaaccagatctcttcactgagtttcagtatttcttttcaaggacaattatatatgtgtattgtgtgatgttgctatgtgttaggaatgtttccttgacacagaaggattaggcaatttttttttttcctgagtacagcacctgttgataagtttgctgaagttcatgtggccattcatgtaaatccaaaaggaaaggggggagatccaaaagggcttccttcagatactctagagatttgaacttttatctcacatttaagttttaatatgctttaaagatagtcttccgttaatgtgtgcagaaacatttcctttagtgatatccacgctgctttactacttcatttcttatactctttatgcaaaaatcagtttttgtctcagagcagtttacactctacagcaattcatgcaagaaaaccaggtgctcctcccacacattcttgcatgtttccagaagagaactaactgttttgttttttcttttttcttttttttttctttgagacggagtttcgctcttgttgcccaggctggagtgcagtggcaggatcttggctcactgcaacctccacctcccgggttcaagtgattctcctgcctcggcctcccaagttgccaggattacaggcatgtgccaccacgcctagctaattttgtatttttagcggagatggggtttcaccaagttggtcaggctggtctcaaactcctgacctcaagtgatccacccaacttggcctcccaaactgctgagattataggcgtgagccactacgtccggccaagagaactgttttctgtgccactctgcaactgaggtcaggattgctttgggacagggagccaaggtccgctgctttgttcctatataatgtatggtaacatatgaacctagccccattctcactcttggtcttcaacccgaaatgagtatgatgacaaatgaaatgcagtatcagcatatgccagggccatggagcaggaatgaagcttccttccttgattgtcttctttacatacacccaccatagtctgatttcatacatgtaaactgtttggcatagaggtcaagcaaggcattaggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttgaatcctttgcactgtattctaacagtgcttgaaggtcaccaaagattaacatcaagtcagccctaattatttttggcctgtctaaagaatttattcattcaacatttactgaataaaattgatatagtcctcatttttaagcagttcacaatctggtgggtgagactagttgtgtacacaaaattatatattgtggaataagtgctataactagagtatatagaaaccgctataggagaacaaagacagaatttagtagttttgctttgttttgttttgttttgttttgagacagagtcttgctctgtcacccaggctggagtgcagtggcgcaatctcggctcactgcaacctccacctcctgggttcaagcaattctcctgccccagcctcctgagtagctgggattacaggcatgtgccaccatgcccggctaatttttgttttgttttgtttttttgtagagatgggatatcaccatgttggccaggctggtctcaaactcctgacctcaggtgatccgccccaactccttgacctcccaaagtgctgggattagaggcgtgaaccaccacacttggcctagaatttattaattctattcagggaagttgagaaaggcttattactagtaactacgactctcctccctttccacacgcataccatcttcatcacccatgacagttcaatccagtaagtatatcttaaattccaagtgtgcataaattgccgtgctttgttctggcaccaacacctattgagtgtgggaactagatcaaacaacttatgagctctatcttatctataaaagtggcatattcgtaactaactcactgaattgattttaggatttaaaaaaaagcacttatgaaagtgcctgagttataggcacatgatagataggcaacaaatgttggttctcctaccccttaaaagaggaataggatattatcacctgatgaaggaagaacagtatgccgaggtcaggaggaacataagtaaatgggtagaaatcttcacccatttgtgcagtcaggaggaacataagtaaatgggtagaaatcttcacccatttgtgcagtcaacaaatacagatagagtgcctattgtatgctacccacttttctagatgctgagtatataaaagtgaacaaagaagacaagaaaactctgtacttgtgtccagcatagctgaagtgagtgtgggaacttgagagaggataatagctagagataagatcacaacagagtaggagccagagggatttttagtttatagtgatgggaagctaaggtaggctctcaacacttcttatctggatgatgatggtacccatgataacatgctatcttattcaattctgcaaacatgtctgtgaacataggtgcttatctaatgctcattttatagataacaaacctgagacatggagtattcatgtaacttgcccaaggtcatacaagtagtaaatggtagggtcaaggttcggacctggttctgtctgaatccaaaatctatgcttaataattattctgattagaaatttgaattttattacatgagttgtaaagaaccatttactttttttaaggaagggagtgacatgatcatatatatgtttaagaaccataattaggctaaatcatataggataaaatgaagcaaagagaatggaatggttatgaccatcttttcatagtgtattttcacatagctaacacttctgtttaaaatttgagctgccatccttttcctaatgccagttcactctagagttatttccctcattctggacatgatacaacattcttttaatcatcgggacttaaagcttttggagtctttgatttttccctttccctcatcttaatattcactgactaaatcctgtttttccttacaatctctcttgaatttgccctttttttgtcttttctacacataccctagttatcattttaagtatatcagtctttgacatttgccaccaaattattctcctatgtcgtttcttttctatatcattttgtattttctactaaattctaagcttaaggccttaaaagtaccatgcatcatttatctcttatccctggtgttcagcatagtcctcaactcacggtggattaaagaatgtacttctccattcatatttgctttgctcctaacctgcctcccctaaaaaaatgtacagtgctacatttcctgagtgacaaattataactttattctggcattcacttgcacctaactctagcaaatgtgtgttctggaaaagtttggcctttgtagtcaacctctgtgtgtgtggtggggtcatatataaacgcagttatacatatatatatatatatatatatatatatatatgtatagaattaaatttaggagtattgctctatagcccagaaaagttggagtttagagaagaatctgcattcggaaacatttattgactatctagtattttctaacatcctcctaggcaccatggattcaaaaatattaccaaagcaaagtctctagccatgtaagagctcatattgagtgtgagagactactatgttgaaatgtttacagtgaatgaagatggccaaaaaaagttattaattgcttctaagatagagaagtcttcagaaatgacatgggagttgagtagtctgaaatgtgagtaggtattttcttggcggataaaaaggaacaaaaaggaagggcgtccacacagagagagctgttggtgcaaaagcacagtggcatgaaactgcatggtatgtttaagcagttgtaatcaggcagacagcagcaggaggcaggttagaaaggtagacaagggtcagctcaagggagtgtcttgtatgcaaaatcaagaacttttcttttccagcagatgacaggagcctttgcaatggatcttttgaatggactctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgatcaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatataaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccaccactaagacttaggcaatctaggcaactattaattggatatttcatgttaatgtaaaattttaatatgatttcatattaaacagctatcaaatggaaatcaattctatttcttaataaactaactcaaacattttggaaatgacttgtacataatcagattagattactcttgttctaccccaagagatgtgtatatccaactagtacacttagaaaagcaaattattggataaatgtctttaaccagtagaactgatgttcttagttgccttctgtgctgacattgaacaacacgatagggcctgagagagatacaatggctaatgtgtgaatggcatagacttggtaagagagactgaaggcatgatataaagtaattaagcttcaataagtaaaaaatattttccattatattttaatattatatatatatatattttaaataattggtctaaggcctctcacacatagagaaaggtttaaaagaccacccatttgtcgtgatttcctgccagtttgaaccattaaaatggtctctgtgtgtttttttttttaaaaaaaaacaacaaatattgcaatacattaagcagcttgtctcccagaccaactaagatacttctcaacttgacaagacaaacatttggccatgtttgcccatgctttgaagggaatattatgattctaaaagaaatacatgcatagtctgtctaaaagtcttttatcatttcatcaaagatactaatacatttaactgatgttgtgctttatttatctttttaaaatgtaaccattaactcttctaaattttgtaacaaattaaattgttagtggaccagatactgaataaatatttattaataaatacaatttttgaaaattaagcacttataagtatgcatgccaaaaactgaaatgttttttaatacaaaacaatctaacacatgtgacaaagaaaaaaaatcacccataaaattgacatatgagcacagtgctatttttctgtttttatatttcctttccagtgttagccatgtgcgttttattgtaaactataatgtacttgtacaatttgatgtcctaaaaaactaggtgggtttttgttgttttgaattgtgttcttttttaaaaaaaaaaattgtttttgtctccatttatgttatgactccaaagagtccataaaatacataggaatttcctttcctttgggaagatgtacctgcaattttttctaagcacttaatgtttccagaattttaggatttaggtagttagtgaacttctaaggaaaaagaaaatgttaatttcctttttatttggaatatccggcatactcttaaaaacgatgcactttgtaaacacatcacacagtaatcccaggtaaagacctctctttaggaatgtgagcttcccattgattcctctacagctgctatccttacttaaggaaaattgcccttgaggtttgtgttgctttttgttctttcagcttgtccttgagttgtgtcatttctaccttaaagtacttaaaagtgtttagtggatcagcatgataatgtaaaattttaaatatttttcctatgtgggataaagtaatccccgaaattttgaaagaaatcattgtgacctcttgaactatcaacattatgcctcctgtggctgtttggttgtttggaaccttgagactaatatttcttctaagttgtttacatcacattgagatgcaaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatctttggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccattgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagatacgctaaacaccccaatttagtcattacacattctatgcatgtagcaatatatcatatgtaccccataagtatacaaatattatgtatcaataaaaaacttaagaatatatagatatttatatatgtgtatatagcgtgtatatatatatatatattttatatagttatgtagtgagacattcaataatcttgtacactttagccactactgctactgacaaaagtagattgtagagcccagccttttgggttagacactataaatttctttctttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagatggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatatcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatacttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaattttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttgatatctgccatgtttccatgtcatgttagttaccgattagctgtttatccactctgactttttcacgggattaataacaatggaagttctgattaaaggcaatgttataggggaaaatctatggattcattccatagtagtatttcttttttatataaaagaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttatagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacctgaaaaaaaaaattgcatattgtctgctattagtttcattgaaaaatctttgagttttttagtaatctattaaagaaaaatctgtggaacaaaatcctgtttttagagtgtttaacttttacttatagtgacttataggacctaagatgcaagaaagtattaaactaaggtttcctaacagatttaaactttgagttataatctaactttttagaagcacagaatgataatataccaatgtgacaaaatgttagtagaattgaccttacttaaatcttagcagcctgagtaaaactgagtatacatattactacattattttaataaaaatgttaacttgtttgttcagcttggtttggatttttttcatatataggatttcaggccgggcgcggtggctcacgcctgtaatcccagcactttgggaggccgagatgggcggatcacgaggtcaggagatcgagaccatcctggctaacacggtgaaaccccatctctactaaaaatacaaaaaagtagccaggcgtggtcgcgggcacctgtagtcccagctactcaggaggctgaggcaggagaatggcgtgaacccaggaggtagaggctgcagtgagccgagatcgcgccaccgcactccagcctgggccacaaagcaagactccatctcaaaaaaaaaaaaaaaaaaaaggacttcaagtaacttaaacaatttttgctgaacgaattgtactctatcaatagcaacaccataaatatgttataaaatttaggggaacgttgttaaatgttagggaatcaaatacatatttatctacataaattttccagtctgtaagacttctttcttcctcactctcaccaagtcagtcctaatttttctaaacaaatgactgtctttaaaataagagaaaaaataagaggtctaaaacagtcacagaatttttttttattattatttttatttttggtaagaacacttaacatgagatctaccctcttaaatttttaagtgtgtaatacattattattgactataattacagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtatctttttaaaggcccactttaaattccaccactctataaaaagcttctccaactattctacctttcaatggcttctcagtttcctccataatactttgaaccttttagctgatcctgtactctcttgcactacagtgtaaaggtttctgtatttatggctgcatactggcatgatgctttctcagttatgtatgatatcattagtctgctttttcaggacaaaatctgtgtcacagtgttacagacaaaatctataacacagtgtcggcataataaattcagctcagtgaatgcttattaaacattaacgtaatccttgttgctttctttattcaaccctacagtgaaattttctgggtgcttggagtaactaaaatatatttgcagatatttaatttcaacttcttacacattaaacaagtagaaaaccatgtcttcaaaaacatattctttaaaagtgattgcttagggcaaaagtagtctatgattttagaattcattataatagttattcttagggtgggttcatgattggaatggaatatgtaggggcttctggggtgttggtcatgttctgtttcttaatcttgatgctagttacatgggtgtgtttagtttctgcagattgattcaggtggccacttatatgcacttttcttaatgtatgttttacttcaaccaagcggtttttaaaagccagtcattcagatttttaatatgtgtaatatgaatagtgaggatggtactacattttaattcagaaggtcctcttgcttttacccatgcttagttatagtgatcacatgcattgtataagtgtaaataggcagctgctgtcagagttaatctgatgttattctaaataattattgttaggaagttgtatgtctcctaaagattttatccaaacaccttttttttttagtctaagagtggataggtgtactttattttaaaaaaagaaagaaaaagagccaccaaccacattatgtaccacgtgaagatcatggtaatctatatcatacttgtcaatattatgctgtcttatatgtcattgaatccttggcacttactgacctaaaatattcaccaataacctgtcgctgctgtcatttttattattttatctttgcttcaatgtcagtaaaaagaatatataggaatattagtcagctttagctcattgtggatttaagcttgttagttaaaaagtgaatattcgtatatcaaatgttctaatttgattgactcctgaagtaaaacacagggacatacttgatacaagaggttgaagtactgatactgagtagtattgtcaaggggggagatgtgagagtaagggaagaaggaagaaagacaaatgaagaaagaactagctttctgctgccacagcagaatcataagaaaagctggatcatgccctgaatggagactcccttgtactactatggaaataggtggaatccaggaatcaacttggttaccattattgtagttttcatcaccaccagtccctctgatatattcatcaataaggatgagcctgcttaagagatgtagggcttagggattggggaggttaccaaacagtatcagagctacctgagcaacaccccacattttccactttttacacgttttgagtgtagcttgaacacaaccaagtcatgggcagtaccattgctgttgtgatttcttgaaattaactggcatcttttgctggaatttggattctacaagttgatgagacaaatttagcaaatataacatttccttgtgccaaagttatatgactcaaactccttaacagtattttcatgtaaaacgatcagaggggaggtggcagttgtagccagttttgcattgccataataaaataccacagattaggtaatttctaaagaaaaaaatttatttcttacagttctggaggctgggaagtccaatatcaaggtgctagtacctagcaagtgccttcttgctctgtcatcccatggcggaagggtggaggggtagaagggtcaatgagcatggatgagagagaaacaagagagagtacaactcgcttttataacaaatctaatcctgtgataacaaatccactcctgtgataaccatattaatccatttttgagggcagagccctcatgacataatcacctcttaaaggccctatttctcaacacctccatggtagggattaattttccaactcatgaactttgggggacacattcaaacaacagcactggcattttaagtttaagattcattgaagtagtgaggagaaaaccctgacttctactggaaactagtagctctgtggcaaaagattctggtatagtcataatctgaaagatgtattcactggaaataatatgtccagggatgagaatcaggacacacacatttgagttccagctttgttaccagctacttttttggacatagtttggccatataacctctcagtgcctatttcctcatttgtacaaaaattttcttaatttgaaaaatagcaatggtaatatctaggctacttatccctcaaggtggttatgcaagtaaaattagatatgcaatatgaaaatgccatatgaaaaaggtgttacatataaaaaattattattcaagctagtatgaggatattaattccagttgattttgattagattttgtttattcagtccagtttaaaaaatgaaggtcagaccaggcgctgtggctcacacctgtaatcccagcactttgggaggccgaggcgggtggattccctgaggtcaggagttcaagacgagcctggccaacatggtgaaacctcgtctctactaaaaatacaaaaaaattagccgggcgaggtggcaggcgcctgtaatcccagctacttgggaggttgaggcaggagaatcacttgaacccgggaggtggaggttgcaatgagccgagattacaccactgcactccagcctgggcaacaagaacgaaactctgtctcaaaaaaacaaaacaaacaaacaaaaaaatgaaggttagaattcacaagttaaaatataaagctttctgaaatgatgtatgattttattaattttagtttttctacatattcttttactcttttccattttggacacttttaaaaataagactaaaaacataatcatgaaggctcatgttattttaaatgacatctctaagctttcatggaagaatcattgtcccccatttaaaggttgatcataaaatttccaatatcctattttgttaggatatctttttccttagcatgtataaacatggaagaaaagataaagcatatagtattaactgaatagcctaagtaattgatagtaaaagtttaggggcaaataaaaaaggtatgaatataaaagattattataataactaataaagatgataaataagtagaaagccaggtcttcaaaaaaattttcttttatgtgcattttaaaggagtagattctgcttgaatttgtagcagaaaacctgaagctaatgtttatgctcggcactgtttcttaattatgcatttgctgatacctaatagtgattatagtaaccactatcatttataaagggctaagtgccaggaattatattaagcatggttttatagaaaaggagactgaggctcagaaacgtgaagtaaagtgcacaagatcacacaatgaataagagcgaatattttttctacttccgtgtctcttgttctttccactataacatggacaataatatcaaaaacataattcaaaaggatataaaatatgaaaattttagttataaatttaatataaactgataaagcagtataaaccttggtaatgtccatattttaatgggaaggtcaattattataattagaaatatctaatcacatcatataaatactgctttgttctaaaacttcagtaaactcttaaatatataaaagtgctatctttagaatttagggttttactcaattgatttttccttctacgtgtccacagagaatagtaacatacattatgatgaggagaaagaataatcatctctgttgcacaccctttttgaggggtgtggtcctcaactaaccacatctttatttaacgctattcgtatgaggaactgcggctgctaaattgttcatttgtatcccttggtttaaatgtgtcagttttcttcagttatctattctctggaagtaagtgtatgctttaaattaatctgtgcacttattcatgtatcttttaccattagaaaacacactgaatagatattcttcggaggaaaatgaattgttgatatctcagcttactcagaaattcagtagaaatgattcttaactcttaaatgggaaaatggcacatggatagaacattttcgtaggaaaaacattccaaacgtatttagcctcaccagtaatggaagaagtgcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctcaaaaaagaaaaaaaaaaaaaatgtggaatattatacagtgttccaggatttagaggacctggaagtatgcaaagatttatcaccttgaaatttatgtgtttttgaatgtatgttattatttttattatttaccttgtgaatctttgctacaataacttgtagtcagaagtctgagaatattggcatccttatgaaaaatgcactgaggaaaacagacaccatttttgcagctttgagactctgctatgtgcgtctcaccatacttcttggtaataaaagtctctttaaaacacactcaaaatacctacttgtaactagcagcttttttttaaagaaggaagactgatgtatatggctgtatttttattatatttgcatgcactgaaatataattattctgaagggaattaaaacaggcaagtgatttcaggaagtggatagagtttaaacatgggacagatcaaatgtataggaaacaagtggtttgtggtaatgattggtgttacatctttcaaggcctgataccattgacatgtggcggtgagcagcatatctctgacacttttgcacagttagcaatgatgttagacagcagttcttcctgaaataagtgagccaaatgccagtgcagctaattggtttacttgggaaatgctattcaccaatataaagcctagaaaagtgaaatttcagtatgcaccttataaactccatcggcatgtagataaccaactaattttgagttacagttggtccagtaccagaagtattgtatggtttatctgaagggactatacagaattcatcactgatatttaaatttttctctatgattgttttatgaaagcagcaaggcaggttatagaattctccgtattgacagatctttaataaataaactttaataaatgaatcaataattggcatagaattaacctccagaaagacacatattgcttagccttaaaagacatttttgaaaaaatgatttacggatacaattttaactctttcattgtactgtcaaaccttattttataattaaaatcctccatgatctggaatctcccttttattaacagtggctaaggagccatagcagtgagactagaaaggagagaaaagattctggaaaatgtgggacttaaatatgtgtgcattgtgacataagtagtggatgagggaaccaccgatggggagaaaaattgcaaaaacaagagtaatatttgtatgcagatatccacctatacaatatatgtgataatttgaaattacctatatctttttttttaaccacacatgattccctgagtagatttcatttctagtatcagcagtgtcatactatgaacgctcaaaagtaaaagttttagaataagctgtaatttcagatccaataatctcagttaaatttggaagaaagtgtcagaggtatttgaaccagagcaactccattttgaatgagggctaggaaaatgaggctgagacttgctgggctgcatggttaagggaacaaattaataatgtttactggccgggcgcggtggctcacgcctgtaatcccagcactttgggagaccgaggtgggcagatcacttgaggttgagacttcaagaccagcctgtccaacatggagaaaccccatctctactaaaaatacaaaattagctgggcatggtgacgcatgcctgtaatcccagctactcgggaggttgaggcaggagaactgcttgaacctagaaggcagaggttgcggtgagccaagatcgtgccattgcactccagcctgggcaacaagagcgaaactccatctcaaaataataataataataatataataataataataataatgattataataatatttactaaacagacccagacttgggagtgtccagatgtcctgatatctggagaacaaaggcattcctaattttgctttaaagataataatatcaattcttgcaaaatatagtaattaagaaagttaatcctgtatcacaaacccttgtagcaaagcacatctccccatatatataagcgttgtacctacggtagatgcattcctcctcttttgggaatgtcctactctgtctatggagtagctgttctttcaccactttactttcttgataaacttgctttaactttggactgcggactcaccttgaattctttcttgcgcaagatccaagaaccctcttttggggtctgcatcgggacccctttcctggaacagaagtacatagaaaggaaatgtttattctgtcagtccagatttcaaaacaaagtgtctagcagaatcaaaccattatcatatttgtattttgtgttctgtctatatttctgttctcaaaactaattatggcatttgatatagttagcgcagaaaagtatacgccgagccttactctgatgttaaatgcttgtggagttcaaatattttgtaaaatactatttacctttctacagatattaatcaaggtagaattacctctctctaaatacagtcttgtctgaagtaaaatcccagtcagtttattatatatcaaaagaagtaaacagcttttttgcttgcttctctaagaaccataatcagttagtcatcttcattctattgccttagtctggtcttccatgatcttaaaaaatgggaaatgactgtgattaatgaagctatttggacgatgatatttaagatgataattgcatttaaatgttatattgtttaaattatatgcaaatatctgagatcaaaggaaacataaagagctctattgtcccataagtagtttccaaattctgctagaaacagttaatatgtttgatcggttctattgtcttgtccagattcttgaattctgtttgtgcaaactggacttgaggggagtatctacagacagagcagcatttctatcactcctcggcagtgttctcttcaacagtgcttattgccagctatcgaaatgtgcagtgtgtgtatgactaagagtggatgagtactgtaacaccttaattacaaaataaatagtgactgtcactgttgctttttatagagctttctgactcaagtgcttggtttcctctgattttttaattatttgcatgaaagaaaaaagaaatcactcctttgacattcgatggagggaaaaggaagagctaattaaactgttgtggaacattattatcctctttagttttacactgacaattctaatgcagagtcactttaaatggctttgcaaatcggaatttgctgggccctttattatttctccaaattcactgaacaagtccattcacagggatattgaaaatgcaaagtaagtccagactgaaatatcatttatttcatgaaacattcattagcactttcagtagctgaagataaaggaaaaaatgtttcacagggagtcatgagagattaatatatacagatttttaaaaacaaaacacagaagtttgaaaaaccatcaggtattgctttgaaaggaatatagagttatatggattttgaatgtgttgaaaaatggcttaaatgtactgagctattcacagcccttggcttttactttttatgtgagttatatctgaacaaaaattttattatagtcagtgttgttcatgctgctatagttaaggttgtcagcatttccattacaaacccactatttcagttggggttcataactcagctttagaagtcaccctgggctaaaggttggcaaatgccttttcaacctgtggtggtaatgatgggtatgagtgtggttaaatatgtagtaaacatttaaattaacatatattacttcttatgttatgaaatattttaattgaataatatattatggttctctgattatagaaactgtctgaggaatgttagctttgtcagtataattgattcagggttaaagaaaactttttttcaatctaattagtccttgtagccaagaaactctgaacatatcttggagccattagccaaacacttcctgctaccaatgagcgatggcttgtaaaaggcactcagtaatatactaacattactgccaaacaactggttaattctgtccaaagattagtgtgtgccacgaggattgaaaagttaaactgacaagtttgagattttgcatacaaccatagccacatacgcaggtaggtaacagattttttaaaatgaaaatcggtttcttttgaattaatctcatttttctggttataaaattaattatttttcctagttatgaaaattaaaatattttagattacttagtaaaaacggaaaaattaaaacagagtaaagaataaaataaattacctataatttctcaaaccagtaataacgactggtaacatgttgatgaatgtccttctgatctttatattatacataaacacagatatgctacaggactgccagcttcatatgcccactgtgcagcagcagaccaatacactgactgcagggttgcagcagaggagtttaatcacaaggcgccaagcaaggaaatgggaggaattctcaagccttgaatttgtttccttgagggattctgggcaagggtgtttaaggggattcataaaagacgggggcggggcggggtgggggctggaaaatttggtgttgtgatcagtgggggcagggaggatgaaatcataaggatgtgtaactgcttttctccaagagtcagcttcttactgggtccaccagaccagcttgattccctagttttgttgatatgcagaacctcctaaagaagcatctcagacaaaaggcttatcttctcacaatgtctgagattttatctatagaaccggaagagaacagagaatcttgtgacaaaggctatgttatcctggggtggtaagtagaaaccagttacaaggaagtgggccaaagggcaagctggcttaatgattgctgctgcaaacctagttggattttattttattttatcttattattttattttatttttcttaaacaatttcattaaattatcttgggaacagtgtcagatatatatatattgctaaggcatactttctctggctgcccagtatcccactgtatgaaatgtttaacttatcacctactgtcgtggatttcgaaatctggttaatgatttatcttagttaatcttagttactttggaataaaaatctgatgaaacctttcagcagctagagtttgctcaggatcttggtcttaagtctggttttagccatttttaggtatgctagttactgtatcctccaaatgttaataatttataattttgattccaaaaatagattaaacacatagaatttattatatattgatcacagagagataccatataccaaacacttaaattccattggcatggttacatattgaagcttttagtgtaaatggagcagactttaaaaattaataaatttggaacatatggaatgatcatttcctttgaattcttcttattttaacttgaagagcaagggaaaaactttcttgcaaaccacatttttccctttaaggtttttgttttttgtttttttgttttttttttttttttcctccctagggaggatatagtggcgggatgcagccggggactctctgtaggaacagaatattatttaatacagaattccatgatccgaaagacctggatttcaatctcaactctgctttctagttatgtatgtgattttagggaaggtacatgacttatgtgagccttacttttctcttccttatgatgtagataatacttgggtcaatggtgttataaatattagatggattatatataaaaatttacttatttgttgattggcatatagctggttccaattaggtaaaaatgatgaaactatgttatactggacttcaaaagttttttgtgggttttttgtttttttttcttgagaagtctcactctgtcacccaggctggagtgcaatggcacgatattggctcactgcaaccttcacctcctgggctcaagcaatactcctacctcaccctcccaagtagctggacccacaggtacatgatgccacacctggctaatttttttgtatttttggtggagaagggggtttcgccacccagactgggaaaagttaaattgagtttagattcatgcgttaaggctgggaagccattgcctactcctgagcaggagagtgatttaatgaaagtgctattctaggaaaattattccagcactgatatcaaaatatctttaaaaggcaagcagtagctgggggtacattgcttttgtctttctctaaaattcatgattatcaataaaagaagactgtctcattacctctgttttagttaagaagctgccagggttttaccattatgttgcagtttttaatctttaggactcatgttattctttacttctgtaacattatagtctcttcatctgtaatttttataagagatatttggaaccttctcattctgtcctccgaagtttaacttttccttcttgtatgcatctcttagtatctctttattattgctttttatatgacttcttaatagctcttcttagtatttcttcttaatatctcttaatattaccttaatattatcaatttcttgagaattatcttccaatgcactaattctctttttttctccccactaattctctctttacctgtatctagcaatcttttcgaatcatctattaagaagcagtatagtgtggtggttaaaagcaaagacttcgaagccagacttcctagattcaagtcatttctctgccacttactagctgggtaatgctggtctagtttcttaacctctctgtgccacaatttcttcattgtcaaaatggatataagagtagcatctgcctcataggtttattttagtattaaatgagtgatgaatgagtttagaatagtacctgtcatatagtaaattttgaatttttctgtttttattgaggttttattattgtagtatctatatttttcctctcatcccctccccctctcttcttctcacagaatctccctctgttacccaggctggagtgcagtggtgcagtcactgctcattgcagccttgacctcccaggctcaagtgatcctccctgctttcgcctactgagtagctgagactacaggcgtgtgccaccacacccagctaatttttgttttttgtttgtttttggtagagacaggatttcgccatgttgcccaaactggtctcaaactcctgggctcaggtgatccacccgcctcagcctcccaaagtgatggtattacagacatgagccaccgtgttccttttattgatctattcattcttttttttccccgtctatttcttgctttatggtgcccctttctttcttcatttcttagatccttatgaacatatttaaaatattgttgttctgatatttattgtttctaaggtatgaatttcaccctttgttatttctgctgactttgtatcatagtggtttttaatgttcatctgattcgcaatttcttcactgagagctcacctttagcagaagttttctttggaagtttcagatgctctgggttgtagaggtaccatatgggatggtttcaatttttctgtctttcctaaattttaccagtttttacattaatttttatctttctattcttttcctttcttttctttttctttgagacagggtctcgctctgccacccaggctggagtacattggtgcaatcatggctcactgcagcctcgaacccccctggtctcaagagatcctctacccttcagcaactgcccccacccctacctcgccatagtgggggctacaagcacatggcaccacgcctggctgatttttgtatttttttcagagctggggttttgccatcttgcccaggctagtctcgaacttctgggatcaagcaaactgcccaccttgtcctcccaaagtgctaggattataggtgtgagccaccaggcctggcctaagttttcaatacatggtctccacacaggttggtaaggcattgaagtttcacctttatacccatagactgatgtggctaactttttccctgctatctttcaggaagtgactgaagcttttctagacttagttttccagatgagaccacccttccaggctcttagctttgtgcagggatctcagttccagctcctcatgtacaagaagcttgtgacataaattctcttccctatgcagatattaaaactctagtctctatgcttatatttagttccttattcctcttagcctgttgcctttagctccctaacagagctttgactttgaattgctactttctgtctggcccctaggaatttgccattcttaattttgagcttggcttttttctttaagttttatacagaacaatttgactagtagtagcttttcacattaacttattcaccattgtgtttggtagaatattgtcaggaataacaatgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaaaaagaaaagaaaaaaagagtgtgaattgccttaggtaaactgaaattgtcaactctgagccaaaacaatgcatcaaatttagaaatgtatgtcttcttatacattgactttactattttcacatgtgtgacttttaacttttcagataatgtatacctattatcagctttctcagtaaattgtttacatcactgaccattaattcttagaagtccttattgctactttttttggtgttcagaaataaattaaaattctcttctttgttcttttacctagtagtgttttacaactttttgaaacatgaacgatgggttaggattttatacaatgaatgatatgaaagttggcttgaatatatacaccacaaggtttgccgtatggtcctctgtcaaatatctgttctcaagatgccccaaggcatcataaaaacaaaatggaaaactgcaacagaagaccaagaaagaaatattttcaggtaaatggtaaagcagggagatgacacatttcgtgcattgtatttcactctttcaacaactatggattgaatgctgaatttgtgccaggtattttataaactgggcacttgtcatacagtggtgatcaaagtggatgtgatcactaccccttgtcacagtctcataggagagacagacaattaattatatagctctagacttaatatgctaggaaagaaacagagtggatacaataatgggtaataatactatatggtgggtgcagggagagggctccttctgatagtgtgttcagagatagcttctctgaagagtggccatttaggtggggacctaaaggctgagtaagaggttgaagtattttctgttggcagggttagagtttcttgggagacataaaatagtttcaaaagaagcattaccaaaataagagtttttataccttcacctgtgaattatacgcttttgtttgtttgtaaacattttattttacaactctacatactctgatgcaattctgtattttggagttttgtttgtttgtttgtttgtttttgagacagagtctcgctctgtcacctaggctggagtgcagtggcgccatctcggctcactgcaacctctgtcccccgggctcaagggattctcctgcctcagcctcccaagtagctgggactacaggcacgtgccaccatgcccagcaatttttttttttttttgtattgttagtagagacgcattttcattatgttggccaggctggtctcaaactcctgacctcaagtgatcctcccgcctcggcctgagattacaggcatgagccaccatgctcagccctctgatgcaatttgagaataaacaagtatagcaagtataagcaaaaggcacaaggtattctgcatagttaaaagtgcagctgcttaaaaaccatcccgtcttctctactctctctctctctctgtcctcctcctcctctttttttctttctctcatattcgtcttacagaatattaaatctgtttccatattgcttggtcccttccttcatcttaagagagatgttaatactgtgcgttcattgagaataaccaaatggatgttagcattgttctttatttaatcttaagtaaaatattgtttttttcttaaaaaaaatacatttatcaaaatttatcttacccttatcaatctcaatacagttgtctttacattaacttctattagttggctattgtcctatgttttatatattcagtaattatataatatggaacaaaagtaagatatcattgctgaatgctgttttatggaaaaagaaaagcctttggcattaatgtaatatatactcctgttgattaatactttgaatgtctttctgtgagatatatacaataatgcccataaaatgatcaattttgataccattctgatgcattaaagatggtgaaataaatgttttaaaaagactgggagatgcgaatacctattttttgaaagcaggttagaatgtaatgcataaatgggcaaatgaaaataaaagcataaacacatagaactaccagggctgttgaatagtacctgactcaggtctcttccctccagaaagactataaaaaaacttctaggcaaaacagttgtgtttcatattttttaagtgctggttagtaaagactttaaaaaactcattacaaagtatttcatgattacagaagaacatgtaatagatagtatgtaaggtataaagaatagtgataatttaaaatcccacgaacttagcacccagctaaagaaatacaactttatcagtgctctttaatgccctgtctgttctgagatcctgtattcctccccctgctccaaacggaactactatcctgaactctgtgtctgttgtccctttgtttttctttatagttttactgtatattatgtatacataaataatctattgtctacttttcctcagttttgaatctttacataaacagaattgtaaaatatgccttattctgcaattagtttttatttttcactaaatcttgtgtttctgagattaactaatattggtgcatgtatctgaatccaattcctctgccacatagcgtttcattggatgactataccacaatttacttagccattctcctgtcaatgtacttgtggtcgccccctccaccaagtcttttgttaatataaacaaagctgacgagaacaatgttttattttgcttcctgatgcaaatatgcaagagtttcctctagggcgctattctgaaacttttttttttatcttagaacctctttactcacctaagaattgaggataccaggaacttttgtttacatctgttaaatgtatcagtatttattcaattagaaatcaaaacagatcatgttaaagcatcagaatatataagcacacattccattaaccatcaaagcagcggtgggcacttgaaacatgagtggcattggaaagttttgagatagagactctggaaactactgtacactctttcaagaatgagagtacaaaaggcagatttcttagtactattatgaatgtagttttgacctcatggacctgctgaagggacctcagagacctgtagctttcatagaccacacattgagaactattgttccaatacaaatctaaggttagaatcattaggtcattatgtctcttcaattactagataacatcaaatatttttctaaagcagttgtactgtaccaatttataatatcaatagcagaatatataagtacttcctttggtacacattctagccaacatttggtcctgtcaaacttttccatttttgacaatctagtggtttaagatggtgtctcactgtggtttcatgttacatttctgtgatcactaatgagcctcaaaatttgtattggccattaaaaagactgttaggtctttttctgatctttcttttgggttgtttatcctctttaaagaaaattctttcaattagttattgaaatattacagatacaaaccccttgtcacttatatgtcctgcagatatttagaaacagttgtggctagtagtagtattacttttaaaaatgtgccttttaatgaacaaatgaacagaattttaaaattagacagtctttttttttttttttgatggaatctcactctgtcactcatgttggagtgtagtggcatgatcttggctcactgcaacctctgcttcctggtttcaagcgattctcctacctcagcctcccgctgtagctgggattacaggcgggtgccaccactcccagctaatttttttgtatttttagtagtgacggggttttaccatgttggccaggctggtctcgaactcctgacctcaaatgatccgcccgcctcaacctcccaaagcgctggattacaggtgtaagccaccacgcccagcctatatagtcatttttatcagtcatttcctttagcacttagactttttgtattttaagtaaccctttctaccttcagttcatgaagatatttttctgtattttcttttattcattaaaacaacactttttgattacctactactatcagacacagttctaggtagtgtggatatggcagtgaaaaaaatacatttaaaaaaaaaccctagactcttagagcttacattctcgaagtggggaggaaaacaataaacacatatgcaagtatctcttagtctcttcagactactgttacagaatactatagactgggtggcttaaacaacagaaatttatttctcagagatctggaagttgggaagctgcagatcagggtgccagcatggtctggttttggagaaggccctcttcctgttttatgcatggccgcttcttactgtgtcttcacatgtcagagagagcagacaggaagcaagtgctttcatgtctttttataaaaggcttgcatcaggtggttggcaataatgaaaaatgtccagattcttaacgtgaagttaaaaattcacaaattgattagaatccacccttatgatctaattatttcccaaaggccctatccccaaataccatcacactagggactagggtttcaacattggaattttgacaggacattcagtccatagcagcatgattttgtatgaaggatagtgataaatattatgtagaataataacgtcagtgagagtgccaagtggtcagaggtggggttctgtaggacagaacagcaaagcacaaacttcccaaggcaattaatgtacttggagagtttgaggaaaaggatgaagtccagataactagaatggagttagcaagaggaagcgtattaggagatctggttgataacagaaacccagatcacctagggcctcctaggccattttaaaggcttgagcttttactttgagatggtaaggcgatggaaagttttgagaaaagaaatggcaggtttttaaaagatcactctgtctcctggtttgagatagtctatatgcaagcaagggacaaaactaggggaacatgtaggaggttgtttcagtaattgaggcagaaatgatggtggcttgcatcaggtggtggcagtagtgaaaaaatgaccaaattcttgatatattttgaagcttttatttgcaattggccagtcacagtggctcccacctgtaatcccagcactttgagagccaaggtaggcaaattgcttgagctcaggagtttgagactaggctgagcaacatggtgagacctcctctttacaaataattttttaagaaacgaacagggagtggtggcacatgcctgtggtcccagccacttgggaggttgaagtgggaggatcacctgagcctgggaggtcgaggcagcaatgagccgtgatcgtgccactgcatttcagcctgagtgacagaatgagactctgtctcaaaaaaaataagacaaaagtacccaaaacaaacaaacaaagatttgcaaattgattaaatatggtttgtgagaaaaacagagtcaaaaatgagtaattcctttttttgttgttttttgttattttttgacatgagtaactagaaagacaaagttgtcatttagagagatgaggaagattgtaggtggaacaagtttaggtacaagagtaagaagttatttttgaacatggtaattttcttatgtccatgttcaccacatagggacaccaagaaagcagttagatatatgagtctggacttatggggagaagtccaacctggacatgtaaatctgtgaggcattagtgcacatagtctttgaagccattagactggatgagattaccaaaggattgattatagatagaaaagggaaggggcctggtgtgtgatccatgacatactataatgtttagagttctagaagatgaaaaggaaccaacagaggggactaagcaatgaccggagaaataaaatggtatttaaatcatatcctgcaagccatctgataaaagtcttttgtaaagagagtgatgaaatttcttaaataaaatgaagtcaagtgaaatgaagacagataattaaacatgaggtctgacaacatgagcctgacaagtcctgtttggatatagtgttggggcaaagaacaagattggaggagattgaagagagaagggaggaattggtaataagaagtattttcttctaaagctcttaaattttcaacatgttctttaaatacattgctttttacctgttacaaaagtaatagtgttcattgtagataatttaggaaaaacttaagaaaatattttatatggtccaaaaaactaactataaccactgtagatattttggtttatagcattggagtccatttttttctgtgcatttttataaattcattttctaaacaaaaaatacattatagacatatttacatgattttcttttttaaaaaattatttatttatttatttatttttttgagatggagtctcgctctgttatttaagctggagtgcagtggtgcgatcttagctcactgcaacctctgcctccccggttcaagcaattctcctgcctcagccccacgagtagctggaattacaggcacgcaccaccacacccggctaattgtattttcagcagagcccgggtttcaccatattggccaagctggtcttgaactgctgacctcaggcaatccacccgcctcggcctcccaaagtgctgggattacaggcgtaagccaccgtacctggcctatttacatgattttctcacgtaagaatgtaccatgtttgtctttccttagtatttttaatggtagtgtagcgttatattatgtattacggtttatatgtagccaatatcctattattaggcacttttcaacattttcttttagaaacattgcagtgagcatttcaatatgtaattatagtctttcattagcatattcttaaagattttgacaattagcccactgggatatgtccagaagagaaatactctgataatggtcggtctgcaaaccttatcatacatacagagggcttaggaatagttgtccacgttgcaaaaattgtaagggttcagtggaagaggaaagctgcccagcagcagaaggtagtccttatagggaagggcagttctctgacagaagaggccttgtccatagaaaagatatgggtagaattgcagcagttgtttgtatgtgcagcagttttttaaataagaaactttccgggctgggcgcggtggctcacacctgtaatcccagcactttgggaggccgcgacgggcggatcacaaggtcaggagatcgagaccatcctggctaacacagtgaaaccccgtctctactaaaaatacaaaaaatcagccaggcgttggggcgggcgcctgtagtcccagctactcgggaggctgaggcaggagaatggcgtgaacccgggaggcggagcttgcagtgagccgagatcgcgccactgcactccagcccgggcaacagagcaagactccgtctcaaaaaaaaaaaaagagtaactttccatattttattgaattgtaggtcatgtaacgaaggttttccatatatctcataggcacaaatataaacattgtatgcattctaaaatcaaataaacacaatctcatttatatatgtctatgcatgtctgtgttgtagttgaggaactttagtttatatgttatactaatagtttactgaatataagtttgaaatatttttctagaattaaggagtatttttaaatcaacttagaattctattttctgcaataggaatatgacaaacattttctcttttttgaccataaactacttgaaccctgtagttttccatttagcttactattttaaggaatgtgataaatcaattgcgaacctttttgttttctttttcttgaggcttctgttgtgatttccagcaaaaaggtcgatgtagacggcattttacctgatgttgatgttgcttgggatcagaattgacaatcaggagtagtctctcagtttagatttacaaaaggccagataacttggatatcactactgcttatagaaacatctctatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatttttggccttttgattgagtattcacaaatcataagtgttccgcttaggagtacttttaaaaagtgaaaaaagggctggacctggtggctcagacctgtaatctcagtactctgggaggccaaggtaggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattataatatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagggctgttctccccttagaggatagtaacttaggactatatcagttacgtctggtaacgatatgccatgtctgtgatactagcatgcatttctataaggaaggaagagatggagggagagaggaatttgttttgaatactctgaaaatgtctagccagtggattataattaccataatcacagtttttggccatttggatgaaagaatgttgttcatgcccatactgctagctaagacagtcatgtgcatactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatacgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcctgcctcagcctcccgagtagctgggactacaggcacctgccaccatgcccggctaattttttgtatttttagtagagtcagggtttcaccgtgttggccaggatggtcttgatctcctgacctcgtgatccgcctgcctcggcctcccaaagtgctgggattacaggcgtgagccaccgcgcctggccgaagtattggttttaagacctctgcagattccgaaattcgtggatgctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgagtgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgatattgatggttattattactaatttttaaagactagtatactcctagcttttcaagacaatgatgaagcaatcctgtacctgtgacaggcctatatttctctttttttttttttttttttttttttttgagacagagtctcgctctgttgcccaggctggagtgcagtggcacaatctcagctcactgcaagctccacctcccgagttcaagcaattctcctgcctcagcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttgacatcccagcctccaaaagtgtgagaaatgattttctgttgtttacaaattacgcagtctgtggtatactgtattagcagcacaaaaatactaagacaaccatcctatgctttagattaaccagtatttaccatataacttgtaaatcggtgttagtggtggtaatgggattactaatgtgcatgtgttaacatgttcattggttcaatgcgaggctgtgatcctgtactctgagtgtgccttttttttttttttttttaattactttaagttccgggatatatgtgcagaacatgcaggtttgttacataggtatacatgtgccatggtggtttgctgcacctattaacccatcatctaggttccctcccctcacctccccaacaagcccgtgtgtgatgttcccctccctgtgtccatgagttctcattgttcagctcccacttatgagtgagaacatgtggtgtttggttttctgttcctgtgttagtttgctgaggatggtggcttccagcttcatccatgtccctgcaaaggacatgacctcatttctttttacggctgcatagtattccatgatgtatatgtaccacattttctttatccattctctcatcgatgggcatttggtttggttccttgtctttgctattgtaaatagtgctgcagtaaacatatgtgtgcatgtgtctttatggtagaatgatttatattcctttggatatatgcctagtgtattagtacattttcatgctgctgatgaagacatacccaagactgggaagaaaaagaggtttatttgaacttagagttccacatggctggggaggcctcagaatcatcacaggcactttctgcatggcagcagcaagagaaaatgagaaagatacaaaagtggaaaacccctgataaaaccaacagatcttgtgagacttattcactaccatgagaacagtatgggggaaaccacccccatgattcaaattatctcccaccaggtccctcccataatacatgggaattatgggactagaattcaagatgagatttaggtggggacacagagccaaaccatatcacccagtattgggattgctgggtcaaatggtatttctggttctagatccttgaggaatcagcacactgtctttcacaacggttgaactaatttacattcccaccaacagtgtaaaagcattcctatttctccatagccttgccaacatctgttgttttgatttgcatttctctaattatcagtggtgttgagctttttttcacatgtttgttggccgcataaatgtcttctattaagaactgtctgttcatatcctttgcccagtttttgatggggttgtttgtttttttcttgtaaattccttgaagtttcttgtagattctggatatcagacctttgtcacatgggtagattgcaaaaattttctcccgttctgtaggttacatgtttactctgatgctagtttcttttgctgtgcagaagctctttagtttaattagatcccctttgttcattttggcttttgttgccattgcttttggtggttttgtcatgaaatctttgcccatgcctatgtcctgaatggtattgcctaggttttcttctagggtttttatggttttgggtttcacacttaagtctttaatccatcttgagttaatttttgtataaggtgtaaggaaggggtccaattttagttttctgcatatggctagccaggtttcccagcaccatttattaaatagggaatcatttccccattgcttgtttttgtcaggtttgtcgaagatcatatcgttgtaaatgtgtgttgttatttttgaggtctgtgttctgttccattggtgtatatgtctgctttggtaccagtaccatgctgttttggttactgtagccttatagtatagtttgaagtcaggtaccatgatgcttccagctttgttctttttgcttaggattgtcttagctatatgggctcttttttggttccatatgaaatttaaagtagttttttctaattctatgaagaatgtcaatggcagttttgttgttgttgttgttgttgttgttgtttttgatgggttcttgctctgttgctcagactggagtgcagtggtgtgatctcggctcaccacgtcctctgcctcctgggttcaagtgattctcttgtttcagcctcccgagtggggattacaggcatgtgccaccatgcctgggtaatttttgtatttttagtagagatggatttttgacatgttggccaggctagttagtctcgaactcctgacctcaagtgatctgctggcctcggcctcccaacatactgtgattacaggcatgaaccactgtgctaaatatgtatctaaggtggcatgagtatatgtgttgttgttgttgttgttgttttgtttctttgagacggagttttgctcttgttgcccaggctggagtgcaatggtacaatcttggctcaccgcaacctccgtctcccaggttcaagccattctcctgcctcagcctccggagtagctgggattacaggcatgcgccaccaccccagctaattttgtatttttagtagagatggggttttgccatgttggtcaggctggtcttgaactcccgacctcaggtgatccacccgcctcggcctcccaaagtgctgggattacaggcgtgagccaccacgcccggcctagagtgtgtgtttttaacaaaggccttccttgccacatcctcattccagtcctagtttagttaatgtgacaatagtagtcttttgcaagataaagattataagtaggtaaccattttagcatttgatgcactttacagattgcaagcaataatatgctataaatttagtttttataataagatcatggtgtgttaatagatcatattctgtaggatagttatagaaagtttttaagtactcttttaaggccaagattcatcaaccatttgcttatcctctcactatttgctgtaatttgtcagtatccttcacaataaaaatagattatgacataccttgggggttcagtgaaggttaggacaagttagggatccaggtaaagcttcagagaggtgatgtaatccccttgatgagattccagtagattaagatcttagtatggcttgtgggggctaggcatgataggaggaagagaagaggttggaattctaggtagaaaaaaacaattaaactgagatataaggtaaagaaagtacagagtaaagtacagagtaaatttgaggagcaataagtagtccatcttggctgaagcataggatatgtgtatagtactgagagaaatcctgtggtggaagaagtttgagactatatcataatggcctcgaatgccatgttaaggattttcaattttatttagaaggctgaggggagaggattgaagaattttgagtagcagaggaattttatcaagaggttgttttgtgatgattgataggaatcatcatcatcatgatatgaataaaatggatagagtaaaaattgaaggtggaccccacttattattaggttactgcagtagtccatgaaagaagaacctaaaccagagtagatgcaactgacattaggaagaaagactcaacagtaatttatatttttatgtggccaggatatgatcaaagacaattctgagcctgaataacttgctgaatagggatgcattttttgccttttttaaaaagaggagagcagtagattcagagaaaggttcctggcttggggagaaattatttttgaacttctctggtttgaagtatacattgagtatatagctagagttgcttaatagggagatgaacatatggtactagaattagaagaagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgtataatacccctgagaggtaaatgtccaatgacatggaattccttactttgtctgggctcctgctgcattgaaaatatattctttgtacttggctggatgcggtggctcacgcatgtaatcccagcactttgggaggccgaggcaggtggatcatttgaggtcagaaatttgagaccagcctgaccaacatggtgaaaccctgtctctactaaaaatatttaaaaaaacaaaaaaaaagaaaaaatgacccaggattataggcacccgtcaccaatcccagctactcatgaggctgaggcacgagaatcgcctgaacccaagagacagagattgcagtgagccaaaattgcaccactgcactctgggagacagagtgagaccctgtctcaaaaaaaaaaaaatatatatatatatatatgtgtatatatatatatgtatatatatatgtgtgtatatatatatgtatatatatatgtatatatatatgtgtatatatatatatatgtatatatatatgtatatatatatgtgtatatatatatgtgtgtgtatatatatatatatacacatatatatatatatatatatatatatatatatatatatatatatatctcacttcttcatactgaattgagatctgtcctcctgtcagctctcactcagttccaccatgggggcaatacagaatctgagatttatctcttcctcatgacagttatttaaatatttgaagcactttccattttgtttacttttctaaagtacttttctatggtacctatgcatactttgttaaccatttcttgattgctgactcctccagaatgttggttattctctcttacttattataatttgtcaatgccccttctaaaatgtcatatgttatttaacctaatgcttcaaataaagttttacctttgcatgatacaattgaacaatgccttatacattgtaggttcaaaggtcaaatctttgaagtataggttcccatcctaaattattgatgacagttttttagcttttatagtaattgcatcttgctgtgaatgcatgttgactctgtggtcaacgaaaaacctcattcctttttttcttttatttttataaacacaaactgcagtcaagttagattatcccaaatcccggacctatataaatgatttaaaaaaaactaattgtaagattttcatttatccctgataaatttaatttttgtttggtttcagttcagcactgctacccattacaaaattttgaatcctgactctatcatctagcatattcgcagtccctttgggttttgtgtcatttgtaaatttaacaagtataccttcaaacagcttcttttaagtcactgatttttttgaaaaaggaacaagaaatgcctgcaactaactaccataaacctcctactggttgacaccaatctaattattaatagccttttaatttaatttttaaaccaaattaaaatctacccacctgtactaatatccagttcttatgcgtgttcctttcccacaatggtatccacagagaatttacccaaaataaaaatatgttatgcatttactttccagttgattttctctaagaaacagttgccagtagtttggcatcagttattttacataatccatgctacttcttgatttttagcatgatgatttataaatttatgaagactttgggcatacccaagcatgaggcagagttgggagtgcttcattttctttaacacaattgagaaaagttgatatttttatcaagacatttgttaaggaagaaacagggaaggtataagaaatctaaataaactggcttgcatactacaggattctaatctccctctagctaatgcagcctacagggcctagcccattccacatagagacctatggaaagtgaggggctttgccttgactcctcatttccactattttggtctgcttccatgttttgagtgtcatttgatacacatcatccaagataatcagtctggattttatgactgttgaatatagtacaagaaaagttatgtccttttgcctgtttacgtaaggaccactctcttaattcctgtttctagaatgaaagaaatgccttttctcaagttgattgttaccaggaatgacttcatattgtttgcgagattccactctatccatatgcttgtggccttttcccatacagagtcaatagtatagtaacttaatacaacctactatcatggaattcatttagtaggaattatcagtttgtaataacagggaatatgggcacaaattgccacttattctggagaaagtgatgagaatgtattagaggaaggagtagggatttagggattgaagactaattaagtagcctttttttttttttttttttttttgcaactgtctctctctgttgcccaggctggagtgcagtggtgctcactgcaacctctgtctcccgggttcaagtgattctccaacctcaacctccctagtagctgagacaacaggagtacaccaccatgcccagctaatttttgtatttttagtagagacaaggtttcaccatgtttgtcagactggtcttgaactcctggcctcaagtgatctgcctgcctcggcctcccaaagtgctgggattacaggcgtgagccaccatgcctggcctaagtacctatattatcttccatatgaaatgtgatgagtaccttaactagtttgtagcaatgtgattgaattatagacagttcgctggtaaaaataggcaaatgataaaatataagagactggggaatataataatcaatataagtaaggagtttttggaaatcaaaaattaagagaactaaagtgtttgtgttacacttgggatcatataaacagaatgctaatgaatgaattgtaggtttttaagggttattttccaaacttagcaaggtaattaacatatcatgctaatacaaatattaatagaaatatagatatactttgagcagcctgcagcctacacctactttcctagagctattgaggttggagagcaaggtgaaaatgatgggtttagatttagttctggattactctgggtgaagattttaagcatgtagttagaagttttacctggagagatatttggaagttgccaaaaagataataggtaaattcaaagaaaagtctttggagtagaagacgaagattgcagataaaatcttagagaataatgcctacctttaggatggaggttgaaaagaacttgccaagaaagagttacaaaagaaaaggaggataaccaaaatctgtgctttatctcaggagccaagagaagaaagcatttttagaatactagggagtaaaacaacaccatcagtgtccacagagaaattgagaagaataagctgctatcaggcctttaagtttggtggtgacatagttatggagatatttcatagaagaggttgaggagactgggaaaggtagattggaagggctcacttaatagaagcagtagtggaggaagcagaagcaatggaccgtccaatacgaatagtcatgaaggtaaggaaagagctttactgtttcttcttcccatttaactgatagctcagtagataaaaaaggagaacaagataaacttatttgttgaaaaattactagaagtttgttatattgtttaaattgatttcaacttcagactgtttaataataagtacatagtttaaccaccataggaatgaatttgagttctttgctctgtataactttaataacagacagatgttagtctttcagcaaagaaacaaaggttgttccctaaattactttagatttacaatgcaatagagcattttaattacattcatatgtgcagacttttaaaaaataatttttaaatggtttattatggtaatagaagcacatttatgccacatcatgcaacacggaaagcatattctctctgttgagtggtgtaaaatgtttgtggcttttgcatctcacatttcttgctttagaagtgctactgtcatttacattctctagtaatccaattgtgaattttatggatatatatgagcatgtgaggacagggtgccagtggaaagctaagaaaaggagaaaggtaaataacagccagagaagttggcaagattactttttcttcaccgtgccaagacagctattttagctgaaaatgaggaggatgggaggtgcacaggaatttagttagatatagaaagagaaaagctgggcaaataattcaggtatgtaagcaagttcaagagatgaatgaagacattattctgatgtctgaagagcggaggttaaaggaaaggttgactaaccaaaaagccttatgtgaacccagggtaatcaataactgcgcttgattagaggtcttgtagcagtggtatatagaagaacagaagaaagatgtggcccccaaggtcgtatttaccagagagaacagtctgagaaacaagccacaaaagaattggtctatgaagcttttctcagaatcagtcgtccccccccctccctccctcccaccctccctcttcccttgctaagtaatggctggacactacagaagtactgtatattcctgggtttatcttaggatatggatagtgaattacaaatgatattttaacccatctattgccattgatatgtaaaaccattttctttattaaaaattgccaatccctatgtccaatattataaaattaatgtctctactaaatgaagaaaaaggttaaaaaataagaagcaatttttaaaaaatccctctttttgcctagccaaaaagaaaaagaaaacaaaaagtgagtaggatttattgtgagaaaatgtaacctttaaagctggcatgctgtttgagttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctcttggtttctaggtttctcgtcacttgcttcaccactgatgatctgctctgtttttcaaccaaattctttgtgaattcatggcattggtagccccattctttgtgtttgtacaatgcactagtctccagagtgtgcattccttgaatgatagaggtttttagttatagtggcatgggccatcactagggtagatgaacagatttgtgattctaggatattacgccagtccagattgggaaaagttttcaaaggtttaaaggtttttctgcgggctgcctttgtttcagcagagtggagagaatttaaaaacatgtacccttaataggaccaatagagtttaaactatatattgtgtaacttttagaaacttttcaaagtacatatcttagcaacttcagaaggatgacataagggtcagcctcactggggatgctgtcccatgttgctccttagttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccatttcaaaaaaaaaaaaaaaaaaaaattcataggtactggactctagaaggtgaatcactgccagtccttcccccagttcattatctgaagtcacaaggcaaagttctttctcctaatcccataaagtcctcgtcctttccccacctaattctgtgtgcagtagccccctctttcaaatgctaagtggacctgactctcatacagagaaataaaaacgggctgggcgcagtggttcacgcctgtaatcccagcactttgagaggcccaggcaggcggatcacctgaggtcaggagttcaagaccattctgaccaacctggtgaaaccctgtcgttactaaaaatacaaaattagctgggcttggtggctcatgactgtaatcccagctacttgggaggctgaggcaggagaatcgcttgaacctgggaggcagaggttgccgtgagccaagatcatgccattgcactccagcctgggcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgtaaagcaagagagtatctaaataggagttgagccatagaatgtaagagctagatgcgcccttagattccatttgctaaaacactgttctgtgaaccagtgttaacctgtgaagttttcatcagcctgtaaatgataatttaaaacacacagaaatttaagctcaatgtattcagtataaagaactactcctttattctgagattatttcttttacatattttttcatgataaaatatcctacttttatgagatgacggtgatgatagatggtaggaattttcctcttaaaataatagcctaatttggcagtataaaaagtgcctcccgattttttgcagtttctgaaaccctaacacctgagaacaactggtctagtttgatctccttatttcatatttgagaaaagtaaggcctaggagaagttaagagagttacttaagactcactactaagaaatcatggaattaaaactagaacctacacattcatattcctagtccacagctctgaataaagcaacaaattccctctctttttcctaaataatacattatttctttctttttctttttcttttcttttttttttttttttttgagacagggtctctctctgtcgcccaggctggagtgcagtggtgccatcttggcccactgcagcctcgacctcctgggctcaagcgattctcccacctcagcctccttagtagctgggaccacaggtgctcgccaccatgcctggctaattttttgcattttttgtagagattgggtttcaccatgttggccaggctggcctcaaactcctgagctcaagcaatcctcccgcctcagtctcccagtatattgggattacaggcataagccaccgtgcccagcccacatttctattcttaaattaacttgaactttgtcaattttatttttcttcttttaccagatttatacttcctatattttgatgtgccagtacttcattgggttaccttcattatgcagttaatttagtttctcaagcacattttaattattgatttctcttattttattaaagtgaattaaaggtacatttgtcttgccaaaaatttaaggccttttattgtccttgtactaagactaagttatctcccagttggtatcatttaataaagacattgattgcattctacttggttgcattctactggtgctggaaaagcgatttcattttctggtgaagtttatgctgacaagttgaatggaaaatatacttgtataatacttttaattacatgttatatgcatttatttattttgctctttagcaggattttagcatcctcacaaaatattatatgactcaaggaactacctactcactttgctttctctgctggaagtaggcaatcaagccaattggaaaatttaaatccgtggattatgggttctaatttctggcctataaataagttagttttgtcataatattatatatttgtataatactttatataataaacacttctttatttctttttggtattcagtgtatcttttacatacattgtcaggctttgttttttctgaaaacactgtgaggacatatttgctcactctcattttgtggatgacagactgaagctcagatgccttaagtaatgtgcccaaaacagcagaactagctaataagtcgcagagtcagatttagaacctcaggtcatatgactacaagtcttgcatttgctccatatctctgctctacggtaatgtttctctttgcatattagtattaaaaatggcttctcccttccctaccagataatggtatgattcttagtaaaacatcccatttccattttaatatcctagaaatttttttttttttttttgacggagtcttgctctgttgcccaggctggagtgcagtggcgtgatcttggctcactgcacgctccgcctcccgggttcaagccattctcctgcctcagcctcccgagtagctgggactacaggcacccgccaccaagcccggctaatttctttttgtatttttagtagagacggggtttcactgtgttagccaggatggtctcgatctcccgacctcgtgatccgcccaccttggcctcccaaagtgctgggattacaggcgtgaaccactgcacccggcccctagaaatattttcaaattgttgaatttgttttagtgatttcacctgtccagataacctaccttaaacatcatgatgagaggggaggggagaaaataaatagtattgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcggttttttttttttttgagatggagttttgcttttgttgcccaggctggagtgcagtggtgtgattttggctcactgcaacctccgcctgccgggttcaagcgattttcctgcctcagcctcccaaatagctgagattacagacatgtgccaccacgcctgactaattttgtatttttagtggaaatggggtttcaccatgttggtcagactggtcttgaattcctgacctcaagtgatccacccgcctcagcctcccaaaatgctgggattacaggtgttaggaagttttgaggaaatacataaaaaacaataatgtgtaactggtaaaagaaaattaaatgaaaggtaaatacaagtgaaggccagttcttgttctgccattgcctggctgctgtactcactatactcatatactatctctattccctctcatgtgccaaaagaaaaatggtaacttaattcataaatttatagtgaggactaattgtgttccccatgagatgtgttctgagtcacatggaaggttatctgtacattcatgtacataagtatatacacatatagacacaaatcataaacagaacttcctaatactaaagaaattatgtgcttacattttctatatatgcctcattttaagaatagtgcaaattcgaatatcttaggaccataagaaggagaaacactgtgtgattcttcatctcatataaggtagagtgtaagttattcttataaacttccttcagacatctaacaatcgatcacatatgtaagaaatttagttagcctattttactggaagataattctatagtagttcctgagctatatctgcattttaaagtatatttactgtgccttgcttactatagatgacatttgtttcagttctcttgtttaccaggggcatggtagggtgatatttatatatttgatttgcagaattagtagcttcagcttaacaaatggctgctcttcagccttttcccaaggttaagtttgaagtgttcaggtcattttatgattttccttgaccacaaccacgttggctgtcaagggctaagattttactaatttgaccaggttgttctttaaaaaccagttattttaattcttttctctatttccccagccttgtgtatttccagttgagtaaaaataaatagaaaatgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacataaaaactgataatacatttcttataaaataacttgctttatcatgttgtatagcttaaattgcttttattccatatatgtgtatggaatatgtgtatacatgcatatgtacatgtacacatgtatatgtatatgtgtgtatctgtatctttttattaatatttgccaatggcataattctacactccagtctctcaagcaagcatttatgtaaagcttgatccagggatatttctttctttacatcatgttccttgcttctttgttgaagcaatttctatttttccttcttttctgatctcccgcaatgttctagttcttgtgaaatattagttttctcagcactgaagttgaaaactttccatataccaactgctgttttcagttctgatttcaaccagggcttggtggaggagtagggtagggaaacttcctgaaaccttgttgatattaatagcaacttaatcctttggcttctactcagatttcgatggactgtacattcatgctcttatctttgaatcatctgacactttttcagccatgaagaaatcagaatatttggtctgttgtatttcctttctaagtactttttaaaggttacctacttttaaaagagctagaccaagtatagtaaaagtatacaccttttcattttggggatggaggagccaagatggccaaatagaaacagctccagtctgcagctcccaacgagacaaatgcagaagggaggtacctagttgatctcattgggactgattagacagtgggtgcaacccaaagagagtgagcacaagcaggatggggcgtcgcttctcccaggaaggccaaggagccagggacctccctcccccagccaagggaagcagtgaggggctgtgctacccgccccagatactacgcttttcccacgaatttttgcaatctgcagatcaggagattccctcgtatgcctgcactaccagggccctgggtctcaagcacaaaactgggcagctgtttgggcaggcacccagctagctgcgggagttgtttttgtaccccggcggtgcctggaacaccagcgaaacaggagaaccatctactcccctggaaatgtggctgaagccagggagccaagtggtctcgctcagcaggtcccattcccacggagctcagcaagctaagaaccatctggagtcgagctgggatgatcaagcttggtgatagggagggtcatccgccattactgaggttttagtaggtggttttcccctgacagtgctgagactgacaggtttggactgggcggaattcatcacagcgtggcaaagcggctgtggccagaatgcttctctagattcctactcaggggcggggcctctctgaaggaaatgccacagccccagtcaggggcttacagataaaactctcatcttcctgggacagagcacctgtggggaggggcagctgcaggcgcagcttcagtggacttaatctttcctgcctgccggcttcgaaggcagcagctgatcctgataagggggattcttccagcacagcgcaccagctctggtaaggctcagtctgcctcctcaggtgggtccatgacccccatgcctcctgactgggagagacctcccaacagggcttgacaaatatctcatacaggagagctccagctggcatcaggccggtgcccctctgggatgaaaattccagaggaaggagcagataacagtctttgctgttctgcagcctccactggtgatacccaggtgaacagggtctggagtggatctccagcaaactccagcagaactgcagaagagaggcctgttagaagaaaaactaacagaaagcaacaacagcatcaacaagaaagaccccccccccaaaaaaaaccccatccaaaggtcatcagcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcaaggaagctaagaaccttgataaaaggttagaggaactgctaactagaataaccagtttagagatggacataaatgacctgatggagctgaaaaacacagcacaaaatctttatgaagcatacacaaggatcaatagctgaatcgatcaagcagaagaaaggatatcagagattgaagaccaccttgctgaaattaggtgtgcagacaagattggagaacatagaatgaaaaggaatgaacaaaccctccaagaaatgtggcattatgtgaaaagaccaactatgattgtttggtatacctgaaagtgatggggagaatggaaccaagttggaaaacacacttcaggatattatccaggagaacgtccccaacctagcaagacaggccaacattcaaattcaggaaatacagagaacaccactaagatactccatgagaaggtcaaccccaagacaaataatcatcagattctccaaggttgaaatgaaagaaaaactgttaagggcagccagagagaaaggttaggtcacctacaaagggaagcccatcagactaacagcagatctctctacaggaaccctacaagccagaaaagagtgggagccaatattcaacattcttaaagaattttcatcccagaatttcatatccagccaaactaagcttcataagcgaagtggaaataaaatcctttccagacaagcaaatgctgaggcattttgtcaccatcaggcctgcttttcaagagctcctgaaggaagcactaaatatagaaagggaaaactggtaccagccactacaaaaacgtaccaaaatataaagaccaatgacactatgaagaaactgcatcaactaatgtgcaaaataaccagctagcatcatgatgacaggatcaaattcacacaaaacagtattaaccttaaatgtaaatgggctaaatgccgcaattaaaagacacagacgggcaaattggataaagagtgaagacacatcagtgtgctgtattcaggagacccatctcacatgcaaagacacacataggctcaaaataaagggatggaggagtatttaccaagtaaatggaaagcaaaaaaataaaaaataaaaaataaatagcagggattgcaatcctagtctctgataaaacagacttttaaaccaacaaaggttaaaaaaggtaaaggagggtactacctaatggtatagagatcaatgcaacaagaagagctaactgtcctaaatacatatgcactcaatacaggagcaaccggactcatcaaacaagttctcagagacctataaagaaacttagactcacacacaatgatagtgggagactttaacaccccactgtcaatgtttgacagattaacaagacagaaaattaacaaggatattcaggactcaaactcagctctggatcaagtggacctaatagacatctacagaactcttgacaccaaatcaacagaatatacattcttctcagcacttattctaaaatggaccacataattggaagtaaaacactcctcagcaaatgcaaaacaatggaaatcataacaagtctctcagaccacagtgcaatcaaattagaactcaggattaagaaactcactcaaagtcacacgactacgtggaaatcgtacaacctcctcctgaatgacccctgggtatataacaaaatgaaggcagaaatcaagaagttctttgaaaccaatgagaacaaggagacagtgtaccagaatctctgggacacagctaaagcagtgttaatagggaactttatagcactaagtgcccacatcagaaagatgggaagatcccaaatcaaaaccctaacatcacaattaaaagaactagagaagcaagagcaaacaaattgaaaagctagcagaagacaagaaataactaagatgagagcagaaatgaaggagatagagacacgaaaaacccttcaaaaaaatcaatgaatccaggagctgattttttgaaaagattaacaaaatagatggactgctagccagactaataaagaagaaaagagagaagaatcaaatagacacaataaaaaaagataaaggcgatatcaccactggtcccacagaaatacaaactaccatcagagaatactgtaaacacctctacacaaataaactagaaaatctagaagaaatagataagttcctggacacatacaccctcccaagactaaaccaggaagaagtcgaatccctgaatagaccaataccaagttctgaaattgaggcagtaattaatagcataccaaccaaaaaagccccaaaccagatggattcacagctgaattctaccagaggtacaaagaggagccggtaccattccttctgaaactattccagacaactgaaaaagagggactcctccctaactcatattatgaggccagcacgatcctgataccaaaatgtggcagagacacaacaaaaaaaaggaaacttcaggccaatatccctaatgaacatcaatgcagaaatcctcaataacatattggtaaactgaatccagcagcacatgaaaaagcttatctaccacgatcaagttggcttcatccctgggatgcaaggctggttcaatatatgcaaatcaataaacataatccatcacaaaaatagaaccaatgacaaaagccacatgatcatctcaatagatgcagaaaaggccttcaataaaattcaacgtcatttcatgttaaaaactctcaataaactaggcattgattgaacatatcacaaaatagtaagagctaattatgacaaacccatagccaatatcatactgaatgggcaatagctggaagcattctttttgaaaacctgcacaagacaaggatggcctctctcaccactcctattcgacatagtattggaagttctggccagggcaatcaggcaggagaaagaaataaagggtattcacataggaagagaggaagtcaaattgtctttgtttgcagatgacatgattctatttagaaaaccccatcgtctcagccccaaaactccttaagctgataaacaacttcagcaaagtctcaggatacaaaatcaatgtgcaaaaatcacaagcatttctatacagcaataatagacacacagagagccaaatcatgaatgaactcatattcacaattgctacaaagataataaaatacccaggaatacaacttacaaggaatgtgaaagacgtcttcaaggagaactacaaaccactgctcaaggaaatgagagaagacacaaacaaatgggaaaacagcccatgctcatggataggaagaatcaatattgtcaaaatggccatactgcccaaagtaatgtatggattcagtgctattcccatcaagctaccattgactttcttcacagagttggaaaaaaactactttaaatttcatatggaaccaaaaaagatcctgtatagccaagacaatcctgagcaaaaagaacaaagctggaggcatcacactacctgactttaaactatactacaaggctgtagtaaccaaaacagcatggtacttgtaccaaaacagacatatagaccaatggagcagaacagagacctcacagtgtaaccccacacatctaaaaccatctgatcttcaacaaaactgacaaaaaaaaagcaatggggaaatgattccctatttaataaatgatgcttggaaaactggctagccatatgcagaaaacagaaactggaccccttccttacaccttatacaaaaattaactcaagatgtattaaagacttaaatgtaaatcccaaaaccataaaaactgtagaagaaaacctaagcaataccattcaggacataggcatgggcaaagacttcctgactaaactgccaaaagcgatggcaacaaaagccaaaattgacaaatgggatctaattaaacaaagagcttctgcacagcaaaagaaactagcatcagagtgaataggcaacctacagaatggaagaatatttttgcattctacccatctgacaaaggtctaatatccagaatctacaaggaacttaagcatatttacaagaaaaaaaaaatcaaaaagtaggcaaaggatatgaacagacctttctcaaaagaaatgtggccaacagatacatgaaataaagctcatcataactggtcattagagaaatgcaaaaccacaatgagataccatctcatgccagtcagaatgatgattatttaaaagtcagcaaacaatagatgctggtgaggctgtggagaaataggaattattttacactattggtgggagtgtaaattagttcaaccattgtggaagacagtgtggcgattcctcaaggatccagaaccagaaataccatttgacccagcaatctcattactgggtatacacccaaaggattataaatcattctattataaagacacatgcacaggtatgtttattgcagcactatttacaatagcaaagacctggaaccaacccaaatgcccatcaatgatagaatggataaagaaaatgtgacacatttccaccacagaatactatacagccataaaaaagaatgagatcatgtcctttgcagggacatgaatgaagctgtaagccatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaatacctaatgcatgcagggcataaaacctagatgatgggttgatgagtgcagcaaaccaccatggcacatgtatacctatgtgacaaacctgcacattctgcacatgtatcctggaacttaaagtaaaaacaaaaataaaaaaaattaaaaatgaaagtatacacctttttatcagcattctttaactctgtctcttccaagctacttctaaaaatgacatgttgtaaaaagaccaatttatttaaatattggaatgattgtgaatatagttatcatgaggtcctaaaatgctgtttcattttgattgtggaggttagtagggaaaatggatacttatgtcataggatcttttacgttgaaagacttggatcatacatgaaaacatatatagaggcatacataatgcatataatcagatgatcaatttataatatccttatatcttagccatatctattgtaatgctgaatgataattaaacattcatttagcatttgacacatcttacgctctgctgaggttatgctaaaagaaattttttttaaattgatgaagatagtatgtttgacagaaaaaaatcaatatgagtgtacctatcaaggggcaggcaatgcttttaaaatgctgtgggtcaggaacactcaggcgtatatacttgtgacatattaaaagcatcctttccagtaataatatcgtttggcagaattattttaatggcctgtgatcctgattctataattctattaccaattaccttgactctgctttcaaaagatgctttaagttttagattctggtattctgatctcagtatctcgtagtgacctcctgttatctactcacttgctactgccagtgtcatggaccatgaattgaacctactgttatcttatggaattttggcactctttctaatcaatcctttgtcatgctaacagtatctttattgttgtttttggctaaattaatagctaaactaggtatttgcatgttttgtctaatcgcttatgaagaaagtactttaccaatattgtgaaaaatgttaccagtcgtatagctttaatgccatgtaacaatgtttacagcgttcaattgaagcactttaatattttaaacccaagttagattgaaagtactcattcagcaagcattttagggattttatggacatcttttaagatcgtctgtgggacgtttgtaacaacagtaatcgcaagaatggcgatgatgatgatgatgatggcagctcacatttattaagctcatagtatatgtcagactctattctaaggactttatatgaattaattcatttaatctttaccagaaccttatgaggtaagaaccatccaattttagagatgtaaatactgaggtactaagcagttaagtgacacgcccaaagttagaaaactaggaagtgtcagagccaaaattggacccccactttttttcatgcctctgattgagatagtaagattttgtcttaccttctgcccagtatttgattaataaaccttatggagcttcacaaaagtaatattttcattaagtgttgcttgtcagtcatgatccatatatgcagaggactaaagagtgtgcaatgatgattgatttttgtactgaaattctttcttttattttgtcaaatgaagaaatttgtcacaagagtgaaccggggccaggtgcagcagctcgcgcctataatcccagcactttggaatgccatggtgggtggatcacgaggtcaggagttcgagaccagcctggccaacatggtgaaaccctgtctctactaaaaatagaaaaatttcccaggcatggtggagcacatctcaggaggctgaggcaagagagtcacttgaacctgggaggcagaggttgcagtgagctgagatcatgccattgcactccagcttcagtgacatagtgagactctgtctcccccctgcaagaaagaaaagtgaatcagcatggaaatgaaaacgttctagtgtcttttcttgtaattattttttatatccatccatccatctggaattcactgtgtgtccaatactgtaataagtgataagaatataatagtaaacaagacatggtccctttttcaaaaaacataattgaactcaggaagagaatagaaacccatttatccttgttgattatatattcacctacctgaaggcagattaactctgaaggagtcaaccagttctgcaatttagattgtaagaataaattttgcttcaaaatagaatttaatttgcttaatttgtttcagtctgttttcagattaacttggatctaattaatgcattagctactattagataaggagtgcttttctgtgttcgctacttttgccaaaagggaatgactgacaaaatcctatataaatttaaggtagaaaatagtctattttctgtggcaatatatatttagaaaggaatgtatagactttctgggtgttttgagataataaaatattctaacaaatgttcttacaaaaaatatcttttgagtaggatgctcattctgttggcccagaattaagtggactattatgtaagcctttgcattatttcaatttttatcacttattttttaaacaacattaaggcaacaaaaggatgtttctgatatccctctcccagtaatgtaaggcagcggtgaggggtttttttttggtcattattttaaggttcttttccccagtctttatcaataggtaatgtttataggtcttcatttgcatttattacccttaactttttaaagtatgatactctttctatgttgctacccttactacataatcatttctaattattatgtaatcctgactcaaattgatgtaccaaaatcatcaatcagtcttctatagagcacagagacctcaaacctttcattattaaacataacttaacattttctgtcttcatgtatctttttatctcctccctttgattatttccttttagatgtaccaagatctgtaaacatttttctactcttcaattttctagaaaaattgttttccaggaagattgtatcaatgtatacaatcatcaggaataaataagcatatgagtttcatcacagcctcaaaaacagtagttttatgtattttatgttactttgacttccaaagagggatagcaagaactgctcataaaaacaagcaaatgcccaaattcaataaaatataaaagtaaaaatgagacattttaaaaaattgtgccaatacatataaagtggtaagctttttgttataacttaaattcctatgactctgaatgaaaaatattttccttttttaattaactttgtcacttcatttgtgaatcgacttcatatgtccttcgtctattgattaagatcaaattttaaccctttatgtagcttgaattctttatataacaaatatttgttgcaaatgttttcctattctgtttattttaattacagttaattataattatcaagaattataactatgacttgatatgtttgtatgttgaaatagtaaggtacttattctcacttaatttttaagtgaactaattgttttggaatcatatatattaattgagtctatcggaactgatactctatactaactgcattttattgttaggaccatttataatcctcttcttaatgattttaacggaaatcacttcttttttttatatttataagcatttagtatattaatctgaatgatgaatacaaattctttattattctgtataccttttgcacatctgaaacatagtattataaaataaaaccttagctttcaaagtcattgtctctgttaagggcttgacaatccaaatttggaggtcaacaaataagcattgacttttcactcttctttgtaattatactataataatctcaatttatgtcaaggaagtgtggatgactctaacttttggaaaaacaaattaccaggtagtataaagtgtgcaaaagaaaaacagattaatgtttcaagatattatttgacctcttttacacatcccttactactgttgacacacttgactttgatatatttcttaaatctttctttcagaagtaatcaagttatttaagaggaaacctttcgatgatagtgtttgttatctctgtgttcatctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaatttgcaactttgaagattgcccttgtgtacagggttaatgtcagatttttagtattaaaaagaaacgactaagaaaatcacaaaacagatacctataataaaacaattgtcctaaaggattatcagcctacctccatgtctgataacagggcaagaaaagaaaatctgagaccatttcaatatgtattttgctaatatcttgagattccacctttccatggaatgataaattttagttctaaaatcatttagaattattaatgttatttgagacaatatggtatgctcttctttattgtgccttctattgaaaataaaatatcccttcagcatctaaaatgtcacttgaattaacactgtgcaatagcaataggagtagataaaactgtcagaaaatgactgggcaatgagacaattattgcagtttattttatcaatctttatttcagagcatgtaaaagtaagtaatgattttgagtctccattttgtgggttatttgagaaaaagatatgttagaacctttcggtttgtgtttttggtataatcataagctgcatgatttgcaatgcctgattttggttctaccttgtttaaatagcttagtttatattatattaattttaatgtagcctcaaccaagatcctattcttacctttctcactaaaaaactgtatagtattaaataatgtgaatcttagggttttttgttttttttttttttttttcaaattgtggttgctaaaagatacaagcagtgttgggtgagtcaggtcatccatgggatttagtcatagaaggacctgatttttatttcttcctctgcaagtaaccagttatgtgatattagacatgtttataacttcttgagacattagtctcctcccataaaataactgtaattgtcaaaattgttctatttagggtgttgctaaaattaaatgaggcaatctgcataaaaaccgtgctttttgcatactcaggagtatgtgatttatcacatttatgtagcttttaaaatttgtatgtaagaagtcattggttaaatagttgaagttttggatatttttatcattatacaatcattattatggtttaattttgtatatatgctttaaaggaatggatgatatgtgtagaaaatgcagtttcagtttgtggaacttagaattgtttttaaaatgtggaattcacatgaagatttgataatagatcaatgttctgttctctgtagaaattacatcattatagggaaaggaattgcacttgtttttgttgtttgagtatatgaactttaacaaggcaacctgagactaatttctaagatatgagatgaaaatgtgttaaaataatagacatatttcagactctgacttcagttgaaaacatagatcccatttttatttctccaaaccagaggaggaaagactgcttctttcctatttttttccctttctatgctattcatcatagcctcttaaaaatgcttctgttttcacttgttcccagattaagaaatgtgttttcattgaaatgttaaaatatgcagtgtgtcacattttgggttaatatcatcaagacaaacaactaagccagttctttatttcctgtcaaattgctgttagttaccaaagccaactaaatactattatatgtcatgttttagaattgtgctttgctttatcagatactaagatgcagcatactggtttgcatctcttagcaatgtttccaaaaccgtaactgtattaaatattagtaaagggctgaatgtacttaagcaatatacaaatgtactcttgatttactgtagagaataattttgttaaaatggttgtattttcatttttatagattcaatagataaacagttattaagcatctatatatcagacactttgagagtacagataattttgtgtagtacctgccattcagtatcctacacatagtaagggaaacagaaatctgaagaagtaaattaccatatagcatattcactcatattaatattaacctcagtgctatggagtacagtggacatagcaaccacctctgcctgttcaagtccaggaaatctttactgagcagctggttttaatcttgatctttgaggatgagtaggaaattgcccagtaaaaaagaaagtgtaagggcggggaattgcatgtgcagaaaattggagtaatgaaaggaccctaacatccatatactagggagtagctagttataggggcataaaatcaaatcgctgctacttgataacttgaagaccaatcttctgttctgacattccatagatcaaacttatataattgtctaatttgaaattgtacaattgtataatttgaaaacgacatgttttcagtgaaaagtaagaacaaaaactatttgttttatctgtgtgtgcatgtgtgtatagtgttaaaagttgtaatgtcaacaggtcatggtggcacgcacctctactcccacctactcaggaggctaaggcaggaagactgcctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcctttaaaaaaaaaatgggtcctggctgggcacggtggctcatgccctgtaatcccagcacttttggaggccgaagtgggtggatcacctgaggtcgggagttcaagaccaacctgaccaacatggagaaaccctgtctctactaaaaatacaaaattaggcgggcagggttgcgcatgcctgtaatcccagctactcaggaggctgaggcaggagaattgcttaaacccaggaagcggaggttggggtaagctgagatcgcaccattgtgctccagcctgggcaacaagagcaaaactccgtctcaaattaaaaaaaaaaaaaaaaaaaaaaaaatcctaaattttaaaatgacgattataaacttgagtattgattttctgttttccttgagttagacagagtttttttctgacaataataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggctcaagtgatcttcccgccttggcctcccaaagtgttgagattacaggcatgagccacagcactgggccatattttctttaagaaagcagtatatttttgttaagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcggatcacgaggtcaagagttcaagaccagcctgaccaatatagtgaaaccccgtctctaccaaaaatacaaaaattagctaggcatggtggcaagcgcctgtagtcccagctactcgggaggctgaggcagaagaatcgcttgaacccaggaagcagaggttgcagtgagccgagatcgtgccactgcattccagcctgggcaacagagcgatatgccatctcagaaagaaaaagaaagaaagtaacaacgcaaacttattttttgaaaaagaaatttagaatttcttaaaatttaaagccaagacatgctctaggaatacaaagaagagaactcctaatttctcctgtgaaaatttaggacatgcttttctttttttttttttgagacaagagtctcgctctgtcacccaggctggagtgcaatggagcaatctcgtctcactgcaacctccgcctcccaggttcaagctattctcctgcctcagcctcccaggtggctgggattacaggtgcctgccaccacacacagctaatatttgtatttttagtagagacagggtttcaccatgttgaccagactggtcccaaactcctgacctcaggtgatctgcctgcctcggcctcccaaagtgctgggattataggcatgagccaccgcgcccagccaggacatgcttttcatgtgagatgacatttgagctggttttggaaagtaacactataaaatgcacatgtaatgaacacatatgtaacaagttattggaatgatcttagttgttactgagaaatctcaattatatgcattttattcaactgatttttattaattttagcatcttgatctagtaggaaaaatcaaatactgcctgctaatacaagaaaaaaaaaatcaaaccaaatacagttgtccttttgtatccttggaggaactggttctataactgctggagataccaaaatttgcagatgctcaagtcctgatataaaatggcctaatatttgcatacaatctaagcatatcctcctgtatactttcgacatctgtaggttacttatgatacctaatgcaatgtaaatgccatgtaaatagttgttatattgagttttaaaaatgtgtattattttttattgttttgttatttttattgattttcaaaaatatttttgatctgcagttgtttgaatccatggatatggaacccatggatacagaggcctgaatgtagatattctaacagtaaattttcttatctgtgagatactataactcatacttaaaacaataagttatctgggcccttacaaatacagacctctggtagagagtctttagagaaattattaaaccttcatataatttgttgagtgtaccatgaatatgttttgtgtgtatgaaattagcagagtagcataggctacgttgtggatgaaaaatgttttatgtgcttagcacattcctctgaaagcaagtcatggagaaagaaatataattatttcaatagaaaaaatttaaaactctgctatattttaatattttagtgatttatatgatataagcatacatgcacttacgattttgcttttttatttcttttcacaagattgagaaaatggagcaacacttcactatttttcttatagggataatatgggcaaattaaatgtaaattgttgactctgaagtgaggggattatttttgttgctgtttcagggaaaacataaataaaagaaagtgaatagatgttatttcctactttagaaagtttgaaaagtaaagataaaaaaggaaaattgtacctatatccattaagttttataagtgctataatgttgccatttttttcagaaaatcatattttaaagccacatcttaattcttaggaattctcaggtaaaattataataaaattcattgaataaatatgattaaatacactagcttcacatgttcctttcttcaggactatcaataataaaatagatggaagtacagcgctgaagagaaactaccctggcaaaagtatatgcttacccatagttgtagctttattgttttcccaagatagacttttcatatttctgcaccttcatttttcatcttactcaccaattgcatatcttttatagatgtcagaatgattagatttagcgtctgcaaaatactcatcgttgagaattatagaccacttagaagattggcaaggacaagttaaaactgaaaataggcatctcaacaggcatgcaaaatcatagcagtgattcagtaaattctcagagatatttcccttttgtgataggaatggggggatagtttatattttgagattctttgcagaataaacactgggagcagaaaattacacctatatttattgccaagctgcatttgttatataatgcattttcctcctccctagatgtaccccaccttctgtcaaaatgttatttctttggctattctttgttgcatgtagttcagttcaggcctgactcctaggattctgcaggtttttttgtttgttttttttaacttcccacccagggaagtgaaagttctgttttaaaaattcctgaatgtgtataaatttcattctgacaagcccactttttcagtatgattttatcagtgcttacaagttttagaaaaaaaaaaaaaagaaaaagaaatctcagatgacctttaatgtcataactgaacttgggttttgaggagagcaaagagagcaacaatttgaagatgtaggtttactagtaaacacttctgttccaccatctgctcccccaccaccccatcgcagattacagtggaatgagataccagggtggggccagaggggccgtggtaaaatggggatgaggtgagagcagggaaggtgatgtgggagcagatggcagctggtgaaagaggcactccatggcactgttggcatggttacagagaagtagatgtcctaacatgctgtgccaattttggaatgtttcaaactctactttgtaacttgtggcctcaaactaaactcattggctgtgtagagcttctcctgtgacaagcagttcctataaaagcattagtttagttatattgtctaacggctgcttaaaatatattcgtgtgtgtttgtgcgtgtgttgtaattaatctatggaaatgtaaaaataaagtatttactgtccttggtctccaggtgaataataattactacatattaacaaccctgataataatatatatgtaataatgaaacagttttgctgtaccatctatttgtgtaacaggagcaaatattgttaaaaacagttcattggattttgttgttgttgttgttgctttacatcagtttataaaagtcatatgagcatttgcctgtctcatctttagatgaatttttgttttccattaaacaaaaaaaaaaccgaaatggcctaatttaagttgaactaggtcattgactaaagtcttatttttgtctaaaaatgcatccattgcaaatgttactgccatttctagtgtctacagtgtccttagaggatatgcatagtgagttgatttgaaaagtttttggccatatggcatggttgaagcaaaaacgtattgtgttaggtcaaaccatgtgtaattgctgatgccacacaatttttttaaatataaaatataaaatagcatttttttgtggttcaacctgatatatacatttttaaattccttattctgaatttgggtaaaaataaataataacttataaaacacgtgtatgtatatttggtcttgcagctaaataagattatatataattttccaaatcttcggagagtccagcttaattaaaaatactatttgcacaaatgttgcggtttgtctctgtagaagctctgagagcattcatttaatttattaacccaagtttctcttgctaatacatttactcagaagtaactctgctgtacataaaaatagttgattcaatagagaagtagctaaacaattttttgttgttgttgttaagtaaagggattaattcatgttagtcactggaatgtcttgcttaaaatttcctccaaaattttttgttcaagttttcattacacttttcccgcaatttaacaaaaatgattttgctccttctttttttttttcctgaaactgtttttagaatggaattaactgattctataaagtacacaaatgattggtattaaatgtctgtctctttagtccacaagtgtttagttttttgaacagagatgaaaattgaattgggctttgtaccaaagatttatatttagataaagttattccaatggtattcaaagtgttaattgtatttctacagcaaacttcatcgtattacaccaaagcaaataccatatttgagatgcatctctaccacatttagtcttgttccttcattttgtttatttcattatttgaagtataaagggagggtctagatgatgatgatgatgatgatgatgatgatgatgatgatgatgatgattgagatggagtttcgctcttgttgcccaggctggagtgcagtggcatgatctcagctcgctgcaacctccgcctcccaggttcaagcaattctcctgcctcagcctcccgagtagctgggtttacaggcatgtgccatcatgccaggctaattttgtatttttagtagagacggggtttcaccatggtggccaggctggcctcaaattcctgacctcaggtgatccaccctccttggcctcccaaagtgctgggattacaggcatgagccaccatgcctggcccaagtctagattattgaatagaaaaacatgatcctgaatgacaaaatgtgtctgaccaaagtagatttacccatgcacagaaatcgaagtcaatttttagtgataagaccccatattaaatatgaatcatgtcttggatttctcctaaattcgctttaacatataatgtgacataattgttaaaggaaggtctgaaagtcatataatccgtctttattcattttcatgcttaaactaacacacaatgctagtataatgtgaccctttaattctgagataattttctggagattatagtttggtttgtggtttttgttttgtgttttatttgttttggggatgggatctcacactgttaccaaggctggcatgcagtgggattatcaccactcactgcagcctcaacatgattggatcaagggatcctcctatctcagtctcctcagtagctgggaccatagacctgtgccaccatgcccttaagctaacattttatttatttatttgtagagatggagtctccctatcttgtctaggctggtctcaaactccttggctcaagcaatcctcccaacccagcctcccaaattgttggtattacaggcttgagccactgagcccagcttgttttgtcttaaagtacaaaaggatctcttgtccttaagtgttccttagatctgagtccaaagcaaattttccttttttcataatgtttattttaaatgaagaaatttgactgttatatatatggctcaaatttttactctaatttctagattgtttacctaagtatcctatcactatttgcagattcacttctaactctccctaaatttcaggccactagtagtgtttttcatgttttttcaaataggaatgattcaaatcgacttatatcagcttatggttttttgactgtttttaaccccccaccagtttttgggtagaaaatggtagatcattctataccatttaaattcaaacatttttaatttatcttagtttctgatatgttttcatttactcgattacatatttctgcaaatataattgaatataagtcaaaatatcatttttcataccttttatacttcctgtctctattttttgccttatattttctaattttctatatttctaatttctagggcaattgatatttaataaacattctctattgtgtagtaaagcttgtatttctaccgatttaaattagtaatatcctattagtttaaacaactttaaaccatatctcaacttttcatagttagttgttttggggtcaactatgaatgaatagaagaatctttgtattagcaattcaagaagcagcaattatgtatttctgagttttttgtttttgtttgagtctagttcaaagtagagaaagttattgtttactgtttttttagtttaaaattaaatgaaaaagatggatatgtcttgaatatcaagtggagtagcatgtactcagaaaaagcaaccatttcctgaccaaattagacccttattaacgatagcacatgatgctgtttaatttgtttggggtatgctcttaccccaattgttaattgtcagtttctgaaaataatcagttttcaacatttcacggtttttcaattaggctatggcaacaaatgccattgttgctaattgccagagtttagtcagtaaaattatgatatggtctttctttaactattatcaggtcacttagtatctgcttcatctttttacgctttaataaactaagcagaagattgagatcattagatatccaactgtaatttagcactgtcaagattaaggaggggattatggtcattaggagcaaaatggtttcatttatggactgagaacaatgaggcccatcaataaaccactttctgcctctaatgatcttacttctctctaattgtgtgctaatctaacaacaaactcattttcttctttcattcttgagggaaagattgctaaacagaaatgctttgcatatatgttgcttttacttccttaagttttggtgtgtgttcatgaatgcagtaaattatttctaggtgaacagatatgtctcttaagggaaatatgctatgttctcttctagtttatcaacatatttttgacagaggaatagattttctgtgattagatgtgctttattattagtaccatcttaatccttatttgagtcattcattgtagaaagagatctgtcttataaaattaccaactcaaaatatctaagtgtgctaagaatcgaaaatgatctcagtaaagtgggtcataagggatatatctcttattgggctgtctgccattctatcacctttatgatagaagttctctaaacccacctctttgtagccacattccttgagaaatcaatgcttgcacttcactgaatttaacatgttgactgaggcccaaggcactctgactgtttgcagctagtagaggatccttgagtacaccctggtacttctgctctcaacatttgagattttggcttatcatgaatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagactatagattttttaggcactaagagaaagaagagctaaaacgtgtcattatagtaccacctcccaaatgttacccatatctaatgagtgaatgaaagaatggcccaggaagacttggaagtctgtagttgttattaatggaatgttccttccactgtaaactggagtgtaagattgtaaaaaataaatacggcattaggaattacataatatgacttgaaacatgccaggacttgtttctgaagattgaggaatgagtatacgttttttgttttttgttttttgttttattttgttttgttttgttttgttttgtttgagatggagtctcaccttgttgcccaggctgggtgcaatggcgcgatctcggctcactgcaacctccacctcccaggttcaagtgactctcctgcctcagcctcccgagtagctgggattacaggtgtctgccaccaggcccggccaattttttgtatttctagtagagacaggatttcatcatgttggccaggctggtcttgaactcctgacctcaggtgatccacccgcctcggcctcccacagtgctgggattacaagcatgagccacctcacccagccgagtatatgttttaaagtatgtaatgtaaatactcaggcagtcagtggagtcacaggaaaattccctcaaggactttaatcagcagaaatgtttgtgtatttgtgtgtgtgtatatatatgtatatatgtgtgtatatgtgtatattccagtagttacagttaatgtatatgtcataacaatacagaaaatgttaatattaaaatttatgtcacctttattcattcacctaatataatcagaattgacaaaacatgttagctattcatggcactgaatggagtattctgagcacagtaggaaactcacaaaattggccaggtgcggttgctcatgcctgtaatcccagcagtttgggaggccgaggcaggtggattgcctgaggtcaggagtttaagaccagcctggccaacatggtgaaaccctgtctctactaaaagtatttttaaaaatgagccgggcatggtggcaggtgctggtaatcccagctactcgggaggctgaggcaggagaattgcttgagccgggaggcagaggttacagtgagccgagatcacgccactgcactccagcctgggtgacaaagcaagacttcgtctaaaaaaaaaactcacaaaatcaataaagcaatgtgggtcaacaggatatgtgaatattataaggatatttccctattctattcatttattatttagtacttcacatagtttattcttagctgattagtgattaaaccattagatagtaatatgtttgttcatttcacccaatatatatttactcctactttgtgcaacacaatatactaggcccattgagaagtacaaaatgtaccccttaccttcaaggacgtgacagaaatataacttttttgataaaatgattgcaaaagatttaatcagggtgacactaagagaatgcttttgaagacttatctcaaacaggtcttagtttattccaagtcttacaaagtcaaagttgcataagtcttacaaagtcaaagttgcataagtcttataaagtcagagttgcaaagtgaatagtgaagcaaatcaagaagatttttttagatcatataagaaaaggtaataatcaaaaagtaaaatccagttgctgaatttaggttagttaatataaggcatgattatgtaaaactgactgtaaaattgagatccagtttttaaaaatccaagttatttgtaggcaaatgttaaacaattaaaaaaattttttttcaatatttttgagacaggatcttgctctgtcacccaggttggagtgcagtggcactatatgagctcactgcagcctccacctcccaggttcaagtgatcatctcacctcagcctcccaagtagctgggaccacacgcatgtgccattatgctatgctaatttttaaatttttcatagagccgagctctcactatattggccaggctggtctcgagtttgtgggctcaagcgatccccccgcctcagcctcccaaagtgttgggattacaggcatgagccactgtttctggcccttaaactatatatataattaaatcctgcccctgattttatattagaaaattcagcaggtgcacgcagcaaatcttagggggaaaatggtagttttcctaatacttaaactttagctgcaaatacatgaggccctggatcctaaaatcattggggtcatatgctagattctgtgtgtatggtagaaaatttgaaaatactatttttgtggggagagaattcatatagaaaatgaagtctgttgacgtatggtaagtaagacaggcgaaaaaagtgttttgcaacttcgcttgttgctctgatactactcattagtgtatgctcacttttttctttctaagatcataccctttattaggcagcaatattcttctaatggagaaaagaaaatgagcagtttacaattatgtaaataagacatagttttttctatttctgaaaagtaatagaacttttttcccctaaatgaataaaatctcaaataaaattagaatccctgtacctcactactcattaaagggtgacactagtaacaatttgtaaagaggaaactgtagaaatgcaataaaagaagattatcttagcaaaattgagatttctctctgtatgtcatgctaaaaatgtagctgagagctggtctttgcaagatcaatgtgggatctatgcatgaaatgtgatttgcatatttaaagaaacagtttaaatcatagcttataacccatgccacagagagaaagaagtaatgtaatgctgttgtacccttgtccatctatgtatagctgagtccatgtgtgtgccaaaagggcacaggtgcacttttaattccccagagacaataaggctggtatgtggggtttataaaagcttttccttttcatgttcaccatggcgattgtgactattttttatatttgggatagcactgccatttcccactaatttgtattagttaaatgtgttcaattctaaaaacctcttgattcatgttcaggatgttagtcatattcattagtttctaattgcattctgtaacctatggtagctctggggacttcaaatgtaattgaaggttttaattttaactcattgaatcaagtagtgatatggtgacatcagtgtcttaagaattttttttttctggaagcattatgtgatatggattgaatgcatgtagaacagttgcagtgttccaacctttaggtgagatgcacttcctaaaagtggcaattgcaatgcacagacaaaggtggatgccaaaggcattttgaaaatgattgatgagacttggtgactggctggttatggttaatacaaaagataaagagtaaaagctaactctgtggttttaagcagtgacagctggaagagtagtaatgccactggggaaaacaggataatcagaaacagatctggtttctgggagaaggtggtctgctcaggtttggatatgatgcttatgaagacatgggacactcaattacatgtttaattttatgtgagactagaagaccattcctcaaataaaagattggggtttgggtatagagatttgggcttatatataataacaatataagatttcagcttatatataataagatataatatattgttattatatataataacaatattacatcttattatatataacatattatatattatatataataagatgtaatattgttattatatatgataacaatatataagatttcagcttatatataatagcaaaagccttgatgtaagagcaatgcattaagacagggtttatagagaaaaaaacgcgtttatagagatcttggggaatgcttccatctgaatggtgggaaggagaatagaatgcagcaaatgaaacaaaggaagagctgtcatcttgctctataaaagtatttagcatgaaagagatctctatttggagttaaagcagtattatggtattggcctcaaacaatttttccatgtgtcaagtagtaatttcttttcaaatattgataagaaatcttcacagatattacaataaatgtattcagaattcttatatactgtgggtctgaaatcaaccataattatttttatgagttgacaaaattataataaatgcaaatatcctttgctgtagattagaggcatttttggaaagtttcctatgaaaaatattttccatttactggggttttctttctaaatattccctttatatgtagaaacttaaaaggaaagagccagagatctcttttggctccatcctcctgccaagcacaattttcttattgcagcatttataataccatcaactaaagatttttatattaaaaacattttacaaagagtcacagacccatttgtatgttttgttttgtttttaaacggagtttggctcttgttgcctaggctggagtgcaatggtgcagtctcagctaactgcaacctctgcttcccgggttctagagattctcagcctcccaagtagctgggatgacaggcgcgtgcctccactcctggataattttttgtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggctttttttttttttttttgagtaaattactcttgaaagggttcttattggtaccctctagaggttcagaagagttaattggcttacaaaacatatgtggatcgaacttggggaatagttcagtcatctcttaacatctggatgtactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgccattcacattttgaaaatattaccaattattttaatattatctactttgaaaatatgggaaacaaaattgttcatgatgtttgtgtgcacatcattcaaagaaccaaaacaaaatttttatcaatctgcattccctcagagagataaaatattgctctgtgaaaatctgattttcaccatatgctaatcataccctcttccacagacctcttctcttacttcctcctgaacataaccttccatcaaaacaagaaacaacacaaaaacatcctccaagaaaaaaagaaattacaaaatacaaaagcaattcacaaagccagaaataaatgtttatttagttaaaaaaaataaaaagatgaatgttgatgacttcaccattgaaaatgatgcctcaatatacaacttggcttcaaagatccttagccttgatttggtcatcacgagttattctctccatttcagcttcccccatagcatgtaaacatcagactttgtcatcacatatgacagtgtagctaccaccaagatctcaagctctgaatgtgtccttgtacccacaaccatcctcacatagcccttgcctctggcgcctgtttttctgttgccctcattatgaccttacccttacccttcctcatcttatttatttattgttaagacagagtctcgctctgtcacccaggctggagtgtagtggcgtgatctcagctcactgcagcctccttctcccgggttcaagcgattctcctgtctcagcctcgcaagtagctgggattacaggcgtgtgccgtcacacctggctaatttttgtatttttagtagcgacgggatttcaccatgttggccaggctggtctcgaactcaggtgatctgcctgccttggcttcccaaagtactgagattacaggtgtgagccatcgcacccggcccctctttcttttctcccaaactatttgctcccctcaagctgcatttgccatataacctacacactgtctagcactgtagaatcctcatacttgcttcaagctcccctcctttagccttctgccgtccacaccctgatattcctgttgctctgatccaatcccaactcccgcatacatgacagaagtcacacagtctacctgatgggatccgttgttccatcatttctaaccttagcctcctaatggagttggggtagcttttcatttaactctaattctgtctttttccccacaacagcaattccaaactaggtttgttctcctcaaatccctgagtctagctaccatattcccagataaacatctcttctcattcttgactgaagatgaaaaaatattcttttcatttactgccacatatctcaaagaagacattacatctcctcctgtttacaaattattttcttcctactaactcttcagtgtgttatcatctgactgatactcccatcaatttatacgtctttgtatttggttgtcttaacctccctacaataaagctccatgggggcaaagacagtggtttgttcccctcacttccttgtttgctattgcagtgctatgccattagcagaactatgtgttaactttcagggcctaaaagaacttcagataccaggttcaccttgtacttcccatacttggaaatactgctgaactaaatcttgccttattctcagcaggcagtagagcatgttggttaagaacacacatgagacttcataacttcaaatattgtctctgccacttactagttacatgactttgaagaaattatttaatctctctttgtctcaggtttttcatatgtaaaactggcataataacaagatacgttttataggatgaaatgagtatgtgcatgtgtgtgtgtttgtgtgtctgtttatacaacactgggatttgtaacttggcaacttcctggaatgtactggagtatcattttaaagcccatggtaatgacaaagagatcagttatttaggatgcgttttggtcaattctaaaaggaagctataagatgggataatggagaatttcatttggactcctccgtgttattttcagaagtgataatttggccattgagattgaatttcatgttgctttatagtggctgatttttccttttatactgactgggatacaggacctggctttgagtttctgcatgtgtctgttgcttttatattttatttatttaatttggggatttacaaaataaattttgccagcctgctttgatcatagctgtctgtggcattgtgctaactcaattaaaaagtttttttttctgtcctgttaaattaacattctattgatacattcaacagaataaacttatataatcaattccacattatagaattcacaatatacattttaccctcagaaggatgcaaagaattgttgtaaggagactcagttgcattatggttatagaggcatcaagaaatccagaggcacagtggctcacgcctgtaatcccagcacttagggaggctgaggccggtagatcacatgagatcgggagttcgagaccagcctgaccaacatggagaaaccccgtctctactaaaaatacaaaaaaaaaaaattagccagacatggtggtgcatgcctgtaatcccagctactcgggaggctgaggcaggagaatcgtttgaacctgggaggcggaggttgtgttgagccgagatctcgccattgcactccagcctaggcaacaagagcgaaactccatctcaaaaaaaaaaaaaaaaagaaaaaaagaaatccagaggcctggtggtgtatacctaggcaatccacttttgttttctctctgtttccatatcctcatgagagatctggactaggaaattgctgatatccctccccaagggggcatttttgttaatctagaacatggatcaacaaactttttctgcagagagcaagatattaaatattttagggcttacggaccacacacagtccctgtcacaaggactcaggactgcctttatagtccaaaagcagccataggcaatatgtaaacgatggacctggctgtttttcaataaaactttatttatggacactgaaatttaaatttcatatacttttcatgtgtcacaaaatgctatccttcttttgatttttttttcagccacttaaaaatgtaaaaagcattcttagttcacaggccatacgaaaacaggcagccagctagatatggcctgcagacagtagttcaccaatcccttatctagtctagccaagcaatgtatacatatgtctatttgaggaacttctatattgaagacattatctcatagtacttgtattagtgaacattttcactttcctttcccttgtttcataaatgatcactaggcatttgaatatttcagagcctttagccagattgcatgtgtatttgtgcttgtatatatttttgccagaacacttgaaagtctctgggccttttattcatctttgctttgccaaatattttcccacctgtatagatgaattaaaattttcaacagcctttctttgaacatgacttttgagaccagttgctatttaaattacacaaaagtatatttagcccttctttgtgttttattccctttttgccagggtggaaggacttttcaggaacatatttgaatagatggagaattctgaaaaacataacccagatatttatttgggtctcagagaagaagacgttttgaaaacaacctttgtggctgggcacagtggctcatgcctgtaatcccaacactttgggaggccacggtgggtggatcatgaggtcaggagatggagaccatcctggccaacatggtgaaaccccatctctactcaaaatacaaaaattagccaggcgtggtggcacatgcctgtaatcccagctactcaggaggctgaggcaggagaatggcttgaacctgggaggcagaggttgtggtgagccaagatcgcaccaatgcactccagcctgtgggatagggcgagactacgtcaaaaaaaaaaaaaaaaaaaaaagaaagaaattttatcaatttatcctgcttgaagtctttcagcgctttctcactacacttaaggtgaaacccaaattccttacggtgtcctacaagaccctacctacctctcaaacttcatctcaaatttttttttaaaatccattattttgttagtagacaaaactacataaagtataataaatttatgacatgataatgcccagataactaatcaagacttgctttatttagggactgctttcagtagtgaggaacttaaaaacatagtacaattatattatctaattgctttagtttgtattgccaatttcttatttcagggcatatagtaatcctattaatatccacagttaatgaataaggaaaatacaaccataggcttactatatcctttgaagcatcttttgtctgacctataaccctattacccaggagaaatattgctaatccaggcaacactaatgtggaatggactctaatggcttcaggactatgacctcagcactgatctcaacaacctgcattcagtttgggtgaaaattcgtggctttgtatatgttacatacctgtggacttcatgcattaaacttgttcctcaaaaactctgtgaagtgcaagaatctgcatatagtcctattaatttccctgaagagttcaggaataaagttaatgaaaaatttacccatgatcacaaaaattacactcaacaaggctaacattattttaatacagcattatagctttatggaaacactatttatgtgtacttaattcttgccaaatagtaatgtggaagacagtatctattcaaatggttcatcaatctgtatgatcttttcacaacttattgaagataccatttaccagaagtaagggtatatattagtaaagttttctttttcctttttttttcattttcatttttttttttttttttgagatggagtctcgctctatcgcccaggctggagtgcagtggcacaatctcggctccctgcaagctccacctcccgggttcacgccattctcctgcctcagcctcccgagtagctgggactacaggtgcccgcaaccacgcccggctaattttttgtatttttagtagagatggggtttcaccatgttagccaggatggtctcgatctcctgacctcgtgatccacccgcctcggcctcccaaagtgctgggattacaggcgtgaaccaccgcgcccggcgtgtaaagttttcattaagtgattgctcagataaaagcatttgtgaatgcttattcaagaagcaggtagtcgtcttgttgtgaaacagtgttcatttatcgcatctagtttgtcaaaacattgtttgacagtattgaatataaattgttttctacctgtttgttcttcgtgacctttttgcagtactatttactcaattattgtagttcacaactaaacacacctataaacatatactcaaaattccaaattttacagactagtaatttcagatttcttaaactaggattttcttctttctagttttagtcaacacgtctacattcttcatagcccttgcttttccatgattttactaatttattttaagcctttctattgttatattaagtagcctcctttgacaacctacacttttatcattagtgttctagttccaaggttaaagaagaatgcattacatagattggacaagtgaagacattagtatgggattgtcataaaggatttatcagcatttgaagctcctgacaagcttttttttttttaatttagaagaatgccattccagccatttaaataaaatctccaggagaagactattcaggttagaccaatatcaagtcgaaaagacttgacctattaaaattattccagtttgagttttaggtgggtggggcatcttttattacaaaacaaccaaatgagtttttaaaaagatttttctttttcttttttctatttttttttttgagacaagagtctctctcgctctgtcgcccaggctggactgcagtggcgccatcttggctcactgcaagctccacctcccgggttcgcgccattctcttgcctcagcctccccagtagctggtaccacaggcgcctgccaccgcgcctggctaattttttgtatttttagtagagacggagtttcaccttgttagccaggatggtctccatctcctgacctcgtgatccacccgcctcggcctcccaaagtgctgggattacaggcgtgagccaccgcgcccggcccgcaaaaaaagatttttcttgacgagaacaaaccattccaccaagactttatccagcattgctttattacttcctagtcctggccttgagctaagactgtcaagaaaggtaggagatttcagtttgttttttagcctttgatttaaaaaatcacgcatagtatttgctgcaggcagaataacacttgcagaagagacagcaggggaagggactgggattcttcaaggggcagcttgactgtctgtccactactgttggtttggtgctcaggcttcagaattttcttattgcaaattattacttagacagtttcaaactttcccttcctccttgttttctttttgttagaagtctctctttattttttcaaacatgcagtcagactgaggttttcaggctgagaacttgtgcaaatgtatgaactcagacattgaagtgtacttagcgaagttttaagagttaaatcatagaatgcagctttcatgttttcttactggatttcctctgctatcagcatcagttcagaccacattatgaatccagttgagaaaaactgcactttcttcccaagggcacatgttagaggagtaaatgatggtacttaagaacacatatttagaatgcacatttttaagttttatggaataagaattctagttgtgttttctgtgaaggtgactttttaacaggttttttttttttttccccctaagaatgagtcattttctcacatttttcttcattatagggattttttatttgggtaccatttaccgtttattttctttaaaggccaaagaagctcacagtgatgagcttttgctattgttactgtataaacacatttgcttcatttccaggtacagcgttcatgtaaaatgaaactaccttataaatgcacttgagaaagaatgcaacagtgtctattgttcaggatgcttgtaatgttccttttcttttttacatatgctttccggatgagtcactttaatggtatgccgttccgctgatagtaattcttcaactaaatatattcagttaaggaaaattacagggtacttatataatcatgtttgggcctattcacatatagacttgcaagagtaaattcttacttggtctttcttagagcaaagatgtaagaagtgctccgttaatttgtcaatggttacaatgaatagaaacatttaattcagaaaaaaatccacaaattcctggaaatgcttttatatttacatagaattacacattcttaatatggtctagacagtgtcactggaatactgtgattttttttcttgcatgcatatctgttctcttatatactgtgtaattgaagagtccttccgttcaaactcttgcttaaaatatgtatcttatactttaccttaggattatgtattagagaaagtctgtcatttaaaatgttttgaatgaggatcaggccactatcatatatttgcttgaagccagggaaaaagtatatgtatatttttcaactgaagcaagtagataaataagatatgtgaggaaagtttctcctacatataactcaagagagtacactaagcttaaaaggttatttatggagtacaaggaagaaagctataataaagaacccgatagctataatttaattttttagtgttataattcagattcagtaattcagtagcagatttaaaaaatgaaatgagagaaaaaaaattaaagtgctaccagactgactaatcagtcattgaaaatgcctgtagtgggaatttactcagatagaaaatgtttgcactgtcattaaagaccccctagtttatattagtgaactaatataatgacaggcacaaaaatataccctgaggctgaggctgtgcaaaggcaagcatttctaacccactctggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaggtaaacacatattaattcttttctaatactttttttttgtctgttaccttttagacaagtctagaaagccaaagtgatgaacttttaaatgccaaggaaatacagactattgcatgggttttaatttccagaaatattatttaaatttggaacttgctaataagtctgataaattggctgttagttagtgtaattgtcactagttcccaaacctaaaattccatgtaccctgtaaaatctaaacacagaaaacacaatctaaatttagttctctttattaaaaaaagaccagctgggcgctgtggctcgcgcctgtaatcccagcactttgggaggccgaggagggtggatcacgaggtcaggagatcgagaccatcctggctaacacagtgaaaccccgtctctactaaaaatacaaaaagttagccgggcgtggtggcgggcgcctgtagtcccagctactcaggaggctgaggcaggagaatggcgtgaacctgggaagcagagcttgtagtgagccgagattgtaccactgcattccagcctgggcaacagagcaagactgcatctcaaaaaaaaaaaaaaagaccaatattacgttaaattaggccatagtagggatagcaggttggaaatgtctgcatttttttcccgtagattacatctaaatagttgtttaattcgtggtagcatgtatacagtgggaatgtgtatgttggaaggtagggtgtaggaaagaggatagtgaaatataaaatgaatatttatgtactaggtataataataagtactttatcaaatcatttaacctaaatgactaccctttaaggaagatattatcatcatcattttgcaaatcaggaaatgaaggcctagagaagctaagtcattggcttaagataacctaactagtaatatgtatggctgagattagaacctaggtctgtctgattcctaaaaccattcctaccccatccaattctgccacagcagcatatataagtaacatgaccttgtgccaatgaatgataaagagtacaggttttatttcatgatgctggccttccaggctccagaaatactgctttacatttacaatttcctgagatgacatcacttatacccctccttaagagtagtgcataccttatagaatttttgtattagataagttaatacataaaactacttagaataatgtctagcacatagtaagtactcagtaaatgttggttattacttaagaacttaagtaatgactaattctttttttttttttcccgagacggagtctcgctctgtcgccatgctggagtgcagtggtgcgatcttagctcactgccacctccgcctcttgggttcaagcaattctcctgcctcagcctcccgagtagctgggactacaggtgcctgccaccgcgccctgctaatttttttgtatttttagtagagatggggtttcaccatgttggccaggatggtctcgatctcctgacctcgtgatccgaccgcctcagcctcccaaagtgctgggattacaggcatgagccaccacgcctggccagtaatggctaattcttacaccacagaaggactagttgaaggaactgggtatgtataggctgggtagattaagaagattcaactgatacatttcttgtaaaataggtagtagacttgatcagtgctactatgaggcaaaattaggagtaatagataagagtttaagtaggctgatttttttttttttttttttttttgagacggagtctcactcttttgccaggctagagtgcagtggcgcgatctaggctcactgcaacctttgcctcccggattccagcgattctcctgcctcagcctcctgagtagctgggattacaggcgcccaccaccacgcctggctaatttttgtatttttagtagagacggggtttcaccaagttggccaggatggtctcgatctcttgaccttgtgatccgcccgcctcggcctcccaaagtgctgagataacaggcgtgagccgccacacctggctaagtaggctgatttttcttatgagtaaataaaaaaattctagtgatatcaactgtcaacaattgaataaggcacttaggatgtagggagtactctgttttagatctaatatatgcaacaccccagatttactgggcactcctttgccatctcccacctccaaacccaggctactcatttcccagccatagtgggaagttaacattgctagaaacaatttcaccaatgaaggaacaggagatgctaaggagtaagcaggtaaatgaattgctcattgtctcctctaagcagctcttttttttttttcttgagacagagtttcactctgtcgcccaggctggagtgcagtggcacgatctcggctcactgcaacctctgtctcccaagttcaagtgattttcctgtctcagtctcccgagtatctgggattacaggcgggcaccaccatgcccagctaatttttttgtatttttagtggagacggggtttcaccatgttggccatgctggtctcaaactcctgacctcaaacgatccacccgcctcagcctcccaaagtgctgggattacaggcatgagccatggcacctggcctctaacctacttttctaagttacatttgttttatctggagaccaggactgactagataatttttgggtccgggtgcagaatgaaatgtggcaccccactgcaaatttttattttattttatttatttatttatttttttgaggtggagtcttgttctgttgcccaggctggagtgcagtggtgggatctcagctcactacaagctccgcctcccaggttcatgccattctcctgcctcagcctcccgagtagctgggactacaggcgcccgcccccacgcctggctaattttttgtatttttagtagagatggggtttcactgtgttagccaggatggtctcgatctcctgacctcgtgatctgcccacctcagcctcccaaagtgctgggattacaggcttgagccaccgcacctggccaaaaagttattaagaatttcaaaatgacaacaaagtattaaacaaaatgcagggccctttgcagcatgggatcttgtacaactgcacaggttgcatatccatgaagtcagccctgacggagacaacctgagacactaaacaaccagcatttttttttttttttttgtaaagctatgacaagttctggaacttaccctcttgtatttgctgtctttccctcatgcctgcttctctgggattatatcccgctcaccccaacaaggccttaagaagtaagctctaacttaggctatgttttgcagggactcagactgtgatactctgtaacctgagtttttcaaatttaagaggctggtccaaatctcctttaatgtcacttttacctcaaaggtaacataattcccccatgcaaagataaacactttacataatggcattgtttaatgcagccataaatttctgtataagctagaattctcagattattacatctccaatattttattctcttttgttcaggcataatataaataatccattagaggggaagaatggaggagcctaagaaagaaaggtgccctttacttttttttactttatccgctttcctcacattcccatttgtctaagcatctcccgaaccacgtctatatattgttaggcagatttcaagtccctgctctctttctctacttatataataattggtatggtaacttcaaatcattatgattatatctaacctctccctgtactttcagttgtggaagtagacataaatttaaatgtgaaccaaaacttcttgaaatgtacatattcatcaataaatatttattgagtgataaatactgagcacagtgataagtactgagggaaaagcaaaaaatcaaatatagatcttaccattaggcagcttggagttttataaaggaaactgttgtttatgtatatgagataaaagacaattattattcaaagcagaaggtgataggtcgaagatcacttaaacaaacaaaaagtacatatgaaatggtagagaatttggagtagagctctggagagatttatagaggactaaagattatacatgtgaaattcgggaggacagatgttcagaaaaatattgatttattcagaatgcaactttagagtaaaagtaatttccctgggttaaaaatattctcacttattacttgacatatgtagactgctgtgtgcatagcaatttgattaggctagttttgtattgaatgattggaagatgaagtcattatcatcatcatcccctttttactagtgccattactattgtgacctaaacctggccttttagcacattttatttattacagaaagttagggaggaaaaataacttttccttttccccattttaggttcattggccacggtctctataccaaaaggcagattagcaaaagaaaataatgcagatttatttaggttttacataacttgagaggggagcattcataaggaaatgaagatccaaagaaacagttaaacctgaggttttctatagtatgtttgatgaaaaatggagaggtgtggaaaaatatgatagggagaaggaaaagtatgtgctaagtataataaactgggagaaatttaacaagacctatttgttcagatttctatgtccctttattttcagagataaggatgttggtttcctcagggtgcatatagcaaagttagctctcaggccggacatggtggctcatgcctgtaatcccaacactttgggaggccgaggcgggtggatcacaaggtcaggagatcgagaccatcctgaccaacatggtgaaaccccgtctctactaaaaatataaaaattagctgggcgtggtggcacatgcctgtagtcccagctacttgggatgctgaggcaggagaatcacttgaaccagggaatcggaggttgcagtgagccgagatatcatgccactacactccagcctggcgacagagtgagactccgtctaaaaaaaaaaaaaagccacatgagtttttgtttgtttgtttgcttttgttttttgtttttttctttaagagaaaggatcaatctgtgttgccctgtctggagaagagtggcatgatcatgactcactgtggcctcgagctcccaggctcaagcgatcctcctaactcagcctcttgagtagctgggactaggcacataaccaccgcacccagcttgcttatttatttatttatttatttatttaaggcagggtctcactctgtcacctaggcaggaatacagtgatgccatcataactcattgcagcctcaactttctgtgctcaagcaatcctcccatctcattttcttttttttaaattttttgtagagacgaggtctagctatgttgcttaggctgctctcgaactcctgggcccacgtgatcctcctgcctcagcctcctaaagagctgggattacaggtgtgagccaccacacccagcagagcttatttttgtattttttgtagagatggggttttgccatattgtccaggctggccttgagctcctgagtccaagcaatccatccactttggcctccacaagtgctcggattacaggcatgagcccccatgtggggcctacatgagggtcttaagacctgtgcccaggaaagatcagatagtccttcctgcaggtgtcatttctaaaagttcttcagcttaaaatactcaatatgccaaggcaccatatttttgggtaatgtgccctgaacttcaccatgtccgtgtaacctaaataacataagtgactggtcaatgttttgtcttcacttttttttttttttttgagacggaatttcattcttgttgcccaggctagagtgcagtggcgggatcttggctcactgcaacctccacctcctgggtttgagtgattctcctgccttagcctcccgagtagctgggattacaggcacccaccaccaggcctggctaatttttgtattttttttttttttttggtagagacagggtttcaccatgttggccaggctggcctcaaactcataacctcaggtaatccgcccacctcagcctcccaaagtgctgggattacaggtgtgagccaccgcgctcggcctgtcttcactttttcaatcaaccaagtggggaaggagaaaccttttgaataattggaatacagcagagaaacctaagtgaaaaaattcaattttaaaatcagagagaattatttcttccatagcaaactcatcctttaaataaagcaagcaatgattggtgaaccattagcaaatttttggcaaaactttcttctgcaataaagaataatttccaagcttgtcagatctaaacaaatggaactaaattggacagagctatttaaactgacagattaatagaaaaaaaatagtctttagtgttagtgtttgatttttagtctcttgaacttccatgtatatttaaggtgatttctcctcattgagttataaagatgtgcccatcaacatgatgaatttgtatctgaacagtttggctgaaatttgccaaggggttgattttggcagtctcttaaatttttcattgtaatgctgatatgtctctgcataagactaactttgcttaaaaataagaaagaatcatagtatttttctatttgtgtttcatggtcctttaatgaaaataacagtatttcagaggcctggatttaaaaaccaatgtcacaggctgtccatcaaattataacacttacctcatctttgcaactagaatcttgccaaatgctgttgatattgatagaagtgttttcatacataattggcagttatgcagcaatagagtatctataaaatagttgaaagttaaaaaaaaattacctggtaaaaagaaggtctcctgacagatctgaaaaatgtgcatgtatttaggagcagtttgaatacaatacataaaattattagttgtcaatgagagcaaaaggaaggtgcagagaatgttaggggtaattacagcaactaatgatagtgtttgagggcaggctgaatctttgtgggtatgtacgttcatttgtgtttgctggggtttgctctaaattatctttctgtatcaacagttatttttcacatctctttgaaaaatactagagatgggaacttttaccatagatattggtttataaaaatcaggatattccaacaaaagaaaaatatttgatccttttacataatttaaccttaaatcatttatagagctactaacgtgcattaataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaattacttaagaatggcaatttagatttatgttaaaaaaaattttaactctcagtgttttggttcattaatgaatactgtgttttgtatggtactttagtgattctgagtaccttcatgaatacaaatattggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctatttctagcctgctggggccaatggctttagaaggaaactcatcacctctttcttcctttctctacccaaaataggttgcttgttctgactcagaaaaaattagatggtataggagagaaaaatcagtcgttcttgacccattcgaaggttcatggctgacaccctataataccatattaacaagagcaaagcatacaaatttatttaatgtgagttttatgtgacacaggaaactccataaatgaagactcaaagaaacagggaaaaaccatgtattttatgggcagttgtgcagaagtatgactggtggataaaaggatatgatctaatggtaataagctgggggcaacccatgaaggctggttcagattattttctgtatctctgtatgacagtcttcccccaggtatggggaaaagacacctgtcatgtgaaggtctcttttttttttttttggagacggagcctcactctgtaacccaggttggagtgcagtggcgcgatcccggctcactgcaacctgggttcaaacgattatcctgcctccgcctcccgagtagctgggaatacaggcacacgccaccacgcccagctaattttgtatttttagtaaagaaggggtttcaccatgttagccaggctggtctcgaactcctgacctcaggtgaccagcccacctcagcctcccaaagtgctgggattacaggcacgagccacagcgcccggcctatgtgaaagtctttggtgaggaaggacagagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtgttctgaaccccaacactttacttttttaaaaaagtcaaagcatcatttttacttaccaatccttgcttcttctgtcagaaaagaaacccattcttaaaagaggacttcttagacttttaaatatgtgttgtggtccattcttaacatcttaaactatctaaaaaagcacatcaaccacgatgtcgaccttactgcttatatccagttgacaaattccttaccacatttacttgcagagattttgtcaatggcagggttttctgttgcccaaaatcagcttagctttttgattgactgctggttaaatcatttccccaaccggaggacagagagtgactgagcagcaggggcaccattaacacattgacaagaagagctgacagaatgttaatgacattaacaccctgtcaactaactatcaacacttgggatttcctcatagtatgagggaagtcatttgaagtggttacaaatcaagttactgagaaggcacattatcctttccagataattcaaaacagatttggggtcttcactgcactgccattatgttaattgtattccacctttatttattaagataataatttttaagtagatgaaaaaactcacagaaccaccagtgacattgatcacctttgagaacatgccagtaacaggtttcagggagatgataatccacactttgtaaagcaaatgtcatataaaattgacaaaatagaaatgaaagcaaaaacaaccctcaagagcaaagctgttgtgttttgttttgttttgtttttaatgaacatagtaattcaggtcattttctggtgcctaaagaaaaattgagaacttcagattaggctggaggggggaagttcatcacctctgactctctccttaccctcactgtctgctcctctcaaatgcagaaaattagaaagttcaatgcaaacatttatgagactgttcagggagaggagggtacaggatttaaaagggggcattgtcagtaatacagataatgcatacattgagaagcaaattgttttagaaaaccacaaggggggccgggtgcaatggctcacacttgtaatctcagcactttgggaggccaaggcaggtggatcacctgaggtcaggagttcaagaccagcctggccaacatggtaaaaccccgtctctactaaaaatacaaaattagccgggcatggtggcacaagcctataatcccagctactcaggaggctgaggcaggagaatcacttgaacctggcaggcggaggttgcaatgagcagagattgcatcattgcactccagcctgggcggcaaaaagagtaggactccgtaaaaaaaaataaaataaaataaaataaaaaaagaggaaaagagtgctttttaaaaaagtaagattcttagcattttttgaaatatactctcttgacaatggtactggtcaatggaatttttagtttaattgaatttaaatagaaagtattatcatttatgataataataaagtagtaggccgggcacagtggctcatgcctgtaattccagcactttgggaggccgaggcgggtggatgactaggtgaggagttcgagaccagcctggccaacatggcgagaccccgtctctactaaaactacaaaaaaaaattagccaggcatggtggtgcacgcctgtaatcccagctactcaggaggctgaggcagaagaatcgcttgaacccgggcagcagaggttgcagtgagccgagattgtgccactgcactccaacctgggcaacagagtgagactctgtctcaaaatgaataaataaataataataaaaaaaacagtaataatagtaataaactgttatgaaagaaaatcaaagccagaaagaagttaaagtggtaaaggccaattttattcagcaactattgcaataggagagagaccttactatacaacgaggctgcattctgatacaacaaaggcaagtggggatttatagccaagaagcagggtggaagtcaggcaatggaacattactagaaggagatatcaaagataaggggattccccctaaaccaacttgataggattcttgctgaaggcaggcaaggctaataagatatgaagagtggaggatgaggaatttgaccatatatgaagggtggaggatttttgctaaacagacccagtaggattcttgctaaaactggactgtcagggccaaggactgagcctaagaatgaggcctagtcaaaaagaggactcaaggctgggcgcggtggctcacgcctgtaatcccagcactttgggaggccaaggtgggtagatcacctgaggtcagaagttcgagaccagcctagccaacatgttgaaaccccatctctactaaaaatacgaaaattagctgggtgtgatggcaggcgcctgtaatcccagctacttgagaggctgaactaggagaatcacatgaacccaggaggcgaaggttgcagtgagctgagatcacaccattgcactccagcctgggcaacaagagcaaaactctgtctcaaaaaaaaaaaaaaaaaaaaaaggactcagaggaacctgactaaaatttggttcaagagagagtctttgtcactgtttagttaatgtcatatgccagccattatgctaggaatatctatatctatatatctgtctatatattttcctaagtgaccgccaaagcaatactatgaagtaggtactattactaactttattttattttatttattttattttattttattttatttattttattttatttttgagacagagtctcgctctgttggccaggctggagtgcagtggtacagtcccgagttcaagccattctcctgcctcagctgcccaagtagctgggactacaggtgctggccaccacacctgactaatttttgtatttgtatttttagtagagacggggtttcaccatattggccaggctggtctcgaactcctgaccttgtgacccacccgcctcagcctcccaaagtgctgggattacaggcatgagccactgcacccagccttaactttattttaaatgtgataaaattgaggctatagaggttcaaccatgtacaggagatcacataggtaatatgtgtggttcatgagggtcagaattccaattttggtctttccgacattaaaccttgtgcttctaaccatggtattgtgctgcctccgaggttagacctgtttgaaaatctgagataagttctacatttgttccctgtgaaactgtttttttgcttccttttcaatctctctcaaatgggaaaaaaaatgttctttttgaaaggattgtaaactgatttaaaaattagctgctcacttataccatctcctccagaaagccttccctaatcatagcaatcaaaattaatttccctattccctgtatttttataacattttaatactttgattattgtacttgctggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatttggtaaaagttttcaattatgaaacacgtggtatcttaagcatacatagtttacaggtaataatagtgatgttagtataattcctcaagtaatatactctggtgcaaaatctcaatcatgtactgttttcataatgcagaaaaatatatcagtatgtttttgtataataaaagtgtgtttacttatttctagttaggatgtgtttgacatatagcttatgaaaagtatggcaagtaaacttggcttttcattcagtaatccctgctcttttcttctgtttttgtttgtttgtttgtttgtttgtttgagatggagattctttctgtcacccaggctggagtgcagtggcgccatctcggctcactgcaacctccgcctccaaggttcaagtgattcttctgcctcagcctcccgagtagctgggactacaggtgcataccaacatgcctggctaatttttgtatttttagtagagacggagtttcaccatattagccaggctggccttgaactcctgaccttttgatccgcctgcctcagcctcccaaagtgttgggattacaggtgtgagccaccacacccagcctttcttctggttttaaattgctttacaagatgaagactgaaaaaaaaaaaaaatacaagaaagtataggaaatcattgtttaataatcatgtaatcatgctgtcttttatgttgcaaatgtaagataggataataatgtagtacattgtctgaattaattaatgaagtgaggaatggaaaaaaatatatgacattactgaaaattatctaattgaattttaataataggattgtatgtatacctagtaagacatatatttatagaactataatcaatttgagaggatcatatctcagctacttatttaaggctaagggattcactaatggtaagaatggaaaaatcaatgaaaaatttaaaaaggccgtgtggacaagctttgcaaagatcatcagtgaggagaataggacctagtcacaaactgatgatgtctgaggagacaaagggcatgagtaactgagttgacaatggttctgagaggtaacggtaacaaaccctctttatcgtatcgaaagcaaatatctagtaagtggcttttcatatctgctaagacattatcaaatttgtgcacagcaactctgttcaattactgatctctagatgcctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaaaaaaaaaaaaaaaaaaaaaaggcctcttttttccaatttcattttatctaactttaaaaacatttttaagttctagctaactttgctttttgtatgtagaccagtaaagggcacatttttcaaaatgtagtgaatgcttgtagagtaagcaggatgctaacacctcattattcaaggaatatccagatgttcagtgttaaactttgattccttacttttttcactttggtaggaaagaggaagatggagcaatagagtttgaaaattcttgcatactttatgaatgatgacattctatatgctatgacacctataaaataaagattaagggggccaggtgcagtggctcatacctgtaatcccagcactttgggaggccaaggtgggtggatcacctgaggtcaggtgttcgagaccagcctggacaacatggtgaaaccccgtctctactaaaaatacaaaaattagccaggcgcgtggcacgcgcctgtagtcccagctactcgggaggctgaggcaggagaaccgcctgaacccaggaggtggaggttgcagtgagccgagatcatgccactgcactctagcctgggagacagagcgagactccgcctcaaaaaaaataataagagccagtcacggtggctcacgcctgtaatcccagcactttgggagactgaggcgggtggatcacggggtcaggagatctagaccatcctggctaacacagtgaaaccccgtctatactaaaaatacaaaaaaaattagccggtcgtggtggcgggcgcctgtagtcccagctactcgggaggctgaggcaggagaatggcgtgaacccgggaggcggagcttgctgtgagccgagatcacgccactgcactccagcctgggcgacagagcgagactccgtctcaaaaaaaaaaaaaaaaaaaaacaacaacaacaacaacagaaacaaaacaaaacaaagaaagaaatgatcttccttccactgctccaaacttctaagacaatgtatgtgaacgctcaacacagacagaaaacctctactgatatctgcctgaggcaggcaaatcacctgaggtcaggagttcgagaccagcctggtgaacatggtgaaaacccgtctctactaaaaatacaaaaattacccaggcatggtggcacgtgccaccatgagtagtcccatgagtagtcccagctatgagtagtcccaccatgagtagtcccttgagtagtctcatgagtagtcccagctactcaagaggctgaggcaggagaatcacttgaacccaggaggcggaggttgcagtgagccaagatcctgccactgcagtccagcctgtgtgacagcatgggactccgtctcaaaaaaaaagatcaaaaatgttctgagaaaacatcaagtagacctctttggctggaagtagtgagagctgttactaagaaagagggtaaaaatcaaattctaaataattaataatattggtctaaggagtttgaacagtatttggtgggttataaattgctgaaaggcaagaaactcttgttccgtcttctccctgcttccagccaccacatggtatttgcctgagagtgatacttgctacctgccaactactgatccaagtaagtactaaagtcagaattgtttccagtattagaaaggtatgtgtgtgcacccagactcatgtgtctgatggggcaaatggttatttctttgtcttcaataatgcatttaactgttctgtggttgaatttgtaatacagttataataacttgcatttatatagtgttttaaagcttgaaaagatcttttatcttctcatgtctaaccctaaatgttctgtagcaaaaattatcatattaagttttgttttgttttgtttgagacggagtctcactctgtcgtccaggctggagtgcagtggagtggtctcggctcactacaacctctgcctccttggttcaagcagttctccctgcctcagcctcccagatagctggattacaggcgcccgtcaccactccgagctaatttttgtatttttagtagagatgggctttcaccatgtaggccaggctggtctggaactcctgacttcaggtgatccacccgccttggcctcccaaaatgctgggattacaggcctgagccaccacacccagccacatattaagtcttgcacctacttgatgttgttgaggattcatccatttcacaaatatttattggttgattactcactgtgtgccaggcactgtgtcagatagttggaacacagtggtgaacaaaaaagatacaatgcttactgtcaaggagattttactttgctaaaagagatagacattcagcaactacataagcaactatggcaggtgataaggaagagatttataatgccatgccagtcaacaacctagttacaaggactgccctccagagagaataatacttgagctgagatctgaaagatgagtaagaattaattcagggaaaaggtgaagaggaatctttacctcagcctgtttatctacaggtgtttcaaatgtttgacagtttggtaccttggcgatgatttggttagtttcttgtttatggtcttactggatttacaatcctagtggagttttaaagttggagttagaaatctctcaaattgagccaaatcctgaggacattttatgtttaaaaaaccctcttaacttttctcccccaaaagttgcttttttactattggctagggattgagtatggatatttttgaaaagctatgtcagattccgtggaaaacctaaagctctgtgaaccttgtgggagctggaatttttcagctaagaggttcgaatagatttaggtatttatccaaaccgaacttttaaaccaccagagatttgcccattactagtttacatagagcttaactacagtggtttcctctttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctgtgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatattgctgtaaatgttgcttagctttgccatctgtcacatactctttttgcataatattttaatccattaaaatgtgtctttttcttttaaaaaacattagcttacttaggttacaatgaaaaccctttaagaaacagtcagtgaccactgacctttccatgtcttaagttactttgtaactgtttttgcctttgtgccccctcattaagatgaataatgacaatccttagaaacaggaaatgccaagctcccagttgcaatgctaacaagtaggaagtcccattaacttttcaacttctcagacaagaaataaatttggacatgagacattatttctgaaactacttgtcctcaggagcagtgattgaatgaactaaggacttgctttcactaagtggaatggaaaactcatgtcacagcatgtcagtttctgcttaatgaatgagatattccctggggaataaattaggcgcctcacgtacataactcttttagggtacccagacctcattgatttccttttgtagaatagtacccacgtgacttataagactcactgtacaactaaactgactgactttgaccctcatgaatagttttgtcacctgggagggtttggttagaaatggtctccaccccttaataagaaagtcagctctttgctccctgttggctcactgctctcaggccactaaatgaaaggcacttgggtgtcatttagagccatttaccaaatgaactatcttggcctgagaaagttaagcactgttgggcctggcaatttaccataatcaaagagctagagcagaaaatatgcaagatctgatttctggccaatttgtgtttttcccgtgttgctcttggcagatctctgttttgagtagcccactcttctacttctctccatgttattaatttgtaaagtgaaacaaattactgacccttgaattgtgctattacacatgcttgagtaattttatttcatttgcagagaatttcatttcatttatgtattatttatactctacctacttccgaaacaatgtgtactggcttattttaattgtaattcaaatcatctgagtatttttccaagtcctgtcctgaagaagacttgtgtcatcacacatcatttcacatttactgtgctatggtgatatattggttatgatgcaatttctctggccacctaaaaacgactgtattaacaaaacatcatgcctgcagtctaatgtaacttcttttgttgtggtgtggtctattgggaaagaacatgcaacttacagttatgtgcttagttctaccatttatgtgacctagggaaagtcatttgccacatcttgctcaagtttactcagttttaaatgtagttgttaatgcttactccccaaacctttcaaggttatggaaatcaatgcagtaaatactgcatataaaatgtctgtgaattcccatatttctccagttaacaccaggaagaataattgtcagctgaactgaaatgatcaagcagcgttcttgtattcaggcactgttcttttttttttcttttctttcttttttttttttttttttgagacagagtctcactctgttgtccaggctggagtgcagtggtgcaatctcggctcactgcaacctccgcctcccaggttccagcgattctcctgccccagcctcctgagtagctgggattacgggcactcaccaccacgcccggctaatttttgtatttttagtagagatggggtttcaccatgttggtcaagctggcctcgatctcctgaccttgtgatccacccgcatccgcctcccagagtgctgggattacaggcgtgagccaccgtgcccggcctcaggcactgttcagacaaatgagggatggagatgtgacaagagagagttcctattttgaggagccacagtgttgtggtgaaaaaggcccagcacacaaacaattataaaattcccaatgggataagtggcacaagtgaggtatgcaaaagtgtcatagctgacaggaagaggaagcaatgaactctggccaggaaaatgggaactaagtgaaaaattagggtaaaacaagataacgtgtgggaaattccttcagaaacactctgtggatactaagacacaatcttatcaatgtcatttatttaacaagcatttatgtattatttacaatttgccagacaatgttctaaatgtcttacaataggaaatcatttaatcctgttcattcaggtctgtttgctgcgaaaaggaattctagaagcactaaggaaatcctagatacagagattcctttgtcttctagtaaggaggaagcatactgggtcagttaacatccacatgtctgtgaggcaaatggttagaaaagtatataccaaaaataaatgaatgaatgaacaaactaaggaataaagacacaatgaaggagatactatttttattttttttttttttttttgagacagagtttcagtcttattgcccaggatgtagtgcaatggcactaccttgactcactgcaacctctgcctcccgagttcaagcgattctcctgcctcagcctcccgagtagctggaattacaggcatgtgccaccatgcctggctaattttgcgttttgttttgttttgttttttgaaatggagttcctctcttgttgcccaggctggagtgcagtggcgtgatctcggctcaccacaacctccgcttcccaggttcaagcaattctcctgcctcagcctcctgagtagctggcattataggcacccgccaccatgccccactaatttgtatttttaatagagacggggtttttccatgttggtcaggctggtcttgaactcccagtctcaggtgatctgcccgtctcggcctcccaaagtgctgagattacaggtgtgagccactgtgcctggcctaattttgcatttttagtagaaatagggtttctccatgttggtcaggctggtctcgaactcctgacctcaggtgatccgcccgcctcggcctcccaaagtgctgggattacaggcgtgagccaccatgctcggccttgaaggagatactattaacctcattttacatgataggaaaactgtggtacagagggactaagttgcccaaggtcacacagctactaagtggcagacctgagtttgaaccaaatgagtcaggctctagaggtggcagccttaacaaggatgctatactgcttctcccatcacccatcaacacagaagtggacatctttattgctggaatccagcactggaatcccttggtggtccttttgatctctgtttcagtacctatagaaacgacaaggacttaaccagctcttgaaacagctgactacatttttggacagttgtaattactagagagttctgaatttgagccaagatctacttttcctggaacttccacccattgatcctatgtctgctttctgacactacatagactaaaccttcttccacataactgtaaaagtattggaaaacatctcccatgcctcctgcttgaattccacattcccatgtaaaaagaaagtgacatttgagagcaattagatttcattattccattgagcatttatttatggggtgcctattgtgtgcaaattgttatacagtgtgctagcaatcgcagagaaaatgaatagcaccagattcgcatgtacaaagtatgtactctgcactaagctattccactgctacccaaaatgtgcaattatcatttaagatacaaactaatgaatagaattattgcctgcacttatttaaatcagggtttaaataagcagtgtcttgctgggtgcacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggccaggttggtctcgaactcctgacctcatgatccacccgcctcggcctcccaaagtgctgggattacaggtgtgagcccccacgcccagcctgttaaaaactttttgagtgcctatttgtgaacaagaaacctttctgctgtctcatctggcataaccttaacatcacgcatttatttgtgctacctaacataattagccatgatagaaaactttaatgtaaaagaaaagaaaagaaaactttaatgtagcatcaaatcttgaaaaatcattttaagattcagttgattattttattagccaggacctctgtgaaatgactctaggatgagaactaaaatataatggaatgggagaggttcattcattatgttagagatttggatagtgctaggcctttaattaattaacatttcattaataatctgtaaggagtaccagtaaacagcactttaattaagttcatgggtaatacattaataggtatagaaaataccaatgaagacaggaaaataattcaaatagaccagataatttataagatataggaaaataacaggaattccactggccgcatgcagttccctactcaagcaaataaaaggcagtattcactgcatacattggggtatagaaaataaacaagtacaataagtaaatatccttgttggctgagcgcagtggctcatgtgtgtaatcccagcactttgggaggccgaggcaggcagatcacctaaggttgggagttcgagaccagcctgaccaacatggagaaacccagtctgtactaaaaatacaaaattagctgggcatggtggcacatgtctgtaatcccagctactcgggaggctgaggaaggagaatcgctcaaacccgggaggtggaggttgtggtgagccaagatcgtgccattgcactccagcctgggcaacaagagcgaaactccatctcaaaaaataataataataaataataaataaatatccttgtcaacaatataatggctacaagaagcaaaaacttttgtttctggtggggcctctgaatatatttctacatatagaaatgtaagaatacaagaaatacatacaagaaatatgaataaatttttatatattttggctttatgcatcttagaaacaaaatgattgtatcatctgaatgacagggctagtaaagaacctacatttactgaatgcaaactactggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacacctcccagacggggtggcggccgggcagaggggctcctcacttcccagaaggggcggccgggcagaggtgccccccccacctcccagacggggcggctggccgggcaggggctgcccccccaacctccctcccgggaggggcggctggcccggcgggggctgtccccccgcccacctccctcctgggtggggcagctggccgggcgggggctgccccccccacctccctcctgggtggggcggctggccaggcgggggctgcccccccttcacctcccagacggggcggctgccgggcggagacgctcctcacttcccagatggggcggctgccgggcggaggggctcctcacttctcagacggggcggctgccgggcggaggggctcctcacttctcagacggggcggctgccgggcagaggggctcctcacttctcagacggggcggccgggcggaggggctcctcacctcccaaacggggttgcggccggacagaggcgctcctcacatcccagacggggcggcggggcagaggcactccccacatctcagacgatgggcggccgggcagagacgctcctcacttcctagacgggatggcggccgggaagaggcgctcctcacttcccagactgggcagccgggcagaggggctcctcacatctcagatgatgggcggccaggcagagacgctccttgcttcccagactgggtggcggccgggcagaggctgcaatctccgcactttgggaggccaaggcaggcggctgggaggtggaggttgtagctagccgagatcacgccactgcactcagcctgggcaacattgagcactgagtgaacgagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtataccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatacaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaattaatgccttcacaaagacaaatatcttgtttatggtgaggaagacttaaaagcaaatctggattttctgtttgactgaaagagtctagatacaggattttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaaggaaattgacagggctagtaattatataatttaaatgatgaactgtggggccatgctaaattgtgaaggaagggaggccaggaatcaactaatagatggcttaaatgaaaagatttctgcaggccggtcgcagtggctcacacctgtaatcctagcactttgggaggccaaggtgggtggatcacgaggtcaggagttcgagaacagcctggccaacatggtgaaccccatctctactaaaagtacaaaaattagctgggtgtggtggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgggttcctaacctttgaccaatgccactgcaaacactgtgcttaaggtgaggttgaagcagtaaaaacaacaatccaatttttttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggccgggctggtcacgcctgtaatcccaacacactgggaggccgaggcaggtgtatcacttgaggttgggagcttgagaccagcctggccaacgtggtgaaaccctgtctctactaaaatacaaaaaaagaaaaaaattagccaggagtggtggcaggtgcctgtaatcccagctactgtagaggctgagacaggagaattgcttgaacccttgaacccggcaggcagaggttgcagtgagccaagaccatgccactgactccagcctgggtaacagagccaggctctgtcaaaaaaaaaacaaaaaagctgggtgctgtggctcatgcctgtaatcccagccctttgggaggccgaggcgggcagatcacctgaggtcaggagtttgagaccagcctggccaacatggtgaaaccccgtctctactaaaaaatacaaaaaaattatccaggcatgttggcacgtgcccataatcccagctacttggtggctgaggcaggagaattgcttgaacctgggaggtagaggagacagaggttgtggtgagccgagatcgcaccactgcattccagcctgggcaacaagagcaaaaactctgtctcaaaaaaataaaaataaattttaaaaagctagtgtgtctatctccatattttttctgtgaattttaactattgtgatggtaatattagtgataggaccaggaatagcttctactaatacaacaagtaaacaaagtaaacacttttttttttttgagacagagtctcactctgttgccaggctggagtgcagtggcgcgttctgggctcactgcaacctccgcctcctggtttcaagcgattctcccacctcagcctcccaagtagctgagattacaggcacccgccacatctcccggctaatttttgtttttgtattttagtagagatggggtttcaccatgttggtcaggctggtctcgaacgcatgacctcaggtgattcccccacctcagcctcccaaagtgctggaattacaggcatgagccaccgggcccagcaagtaaacactttcatatacaatactgtcatttgatccttcaactatctggttgtcaggcaaggcatatgttattatccttagtttacagataaggaaacagttaagtcacttgccaaaaattacatgactagtgattgatgtatacaggatttgaatcagcccttctgacatttacactactgatatttctgctctattaatactgctagttttattagctacttatagaagcaattttttttttttttttttgagacagagtcttgctctgtcacccaggctggagtgcagtggatcctcctgcctcagcctcctgaataggtgggaccacaggtgcatgacaccacaccaggctaattttttaatctttatttttgtagaaacagggtcttgccatgttgcccaggctggtctagaactcctgggctcaagcagtcctcctgtgtcaccctcctaatatagaagcaatttttaaaacatccatttgtacagtatttagtagattttattaaattgtaactgaagttattgtctactgtgttttcaaagcctctcattacagagatccacatgatgaaatttgtactaccagaaagatctttatgtagaaagatgtctgttttcttttaatcagatgttaaaaattatgttacatgcatcactcttttagcctagctgccagagaacctatgtgccaatttaatacccaatttttttttttttttttgagacggagtctcactctgtcaccaggctggagtgcagtggggcgatcttggctcactgcaacctccgcctcctgggttcaagcgattcccctgcctcagcctcccgagtagctgggactacagggatgtgccaccatgcccggctaatttttaatatccaatttttaaaactagctcatacagctcctcaactcactcaagagcatgtctactattgttatcgttgataatgctattttcacattatatttaactttcttatattaaatgttataagttgcttcaaatatatttggaagcggtcaggatataaattcttaataaactaaataatagccatttggaaatttatgcaaaagaaaaaagcagtgtttaaatggctgagcaatagtataacagacttacccactcaagcttattaaagccagaattaactgacaagtcagataagcattccctaattaaatgaaagaggagaatgaataataacatgaaagtgaaaaaggatgtgtgagcctacaaaagacttaggccaacaaatctactcttagagattttctaatgtcactataaattctagtacctctgtgtcctactcaatatctctcgtgtttttatcgtcttccatgcttaggtcttgtttttattttaggcctgtctttgttgatatttctttcttttttttttttttttttttttttttgagacggagtctagctctgtcgccagtctggagtgcagtggcacaatatcttggctcactgcaacctccgcctcccaggttcaggccattctcctgcctcagcctcccgagtagctgggattacaggcatgcaccaccaggcccagctaatttttgtatttttagtggagacggggtttcaccatgttggccaggatggtctctgtctcctgacctcgtaatctgcccaccttggcctcccaaagtgttgggattacaggcgtgagccactgcccccggtctttgttgacatttctttattattattttgtgtatgtcatgactagggatttagatatttgaaggccttgtcttttataatagatataacaagtaaatttaggaactttatattttataaatagttgattatttttatagactcactatgtttagattgttttaggtgtttatttctttttgtaatttaagcacttagacttagttacactccagggaaaaacaacattcttttaatagtcttggtttcacattttcttgattctcttgtctatctttgtttgttcctaatttgtacataaatagtgattaaagttcagagtggctactgcaaaagataatgtttgaatttcaaaacttaccttatttcttttatgatattaatatgttcgaagtatcaagtaaaattttagcatttgagaccatgtggaatataagcttctatgtataggggagatcttataaaaacagcttgaaggaaggtgttcagcagaatttattggctggattgaatatctagtccaccattcacccctatatttgaatggattccttgccttcttatcctgggtaggttcgtagtttatcttgtcacatgccagccgttgttgtccaccctggacttcgcctcttaagtaatagacagcccctgactttcacccataaattatctgatggtgactggtttgcctccttggttttctttcactgcccagtgccagcctatctaagcaagatctctataaagataacatccttatttattaggactggaaagtaatttagaaacattccagttcgttggtcttaatttatggatgagaaaactgagacccagaaagaggaagtgacttacatctgtattgaataacattttgtaacatattggaatccaaacatgcagattatttctatagcactttgtctagtttttttaagaaattatatttctctttgagttattcaagttatatttgtgcatattagttacaggaggcagattagtctttcttactttatttcacacagatgattataggaatgtagagcatccacaagaaaaaaatcaatagcacttaatataacaatttagatatatcatactctattgaactttgaagctatttgttatacactatcatcatcatatttttttctcttaaacatatgtaggtcataaaattgaattgtaaaattgcgagtaatttttataatttagcaaatattcaactaatatttacggagttccaggtatgtgacattacatttgtgttttctttacgccatcactacttgatcttgcttttgtgtacgaaacacttcatctgcttttataattttcctctattttaccttctttcttcatttcccttggctgtcttcactagtcccaaaactttaatcaacgctttaacatgcaggactattagctttatgtctcccttttttgctcactctttgacacaccagccctaatcttctaaccattaactccatgtttctacctagatatagatccttaacccccgaactcagtatatttactaataaactcattcatcttcctctggaatctatttcttttaatgttaccatcactttccttagttatacaggtttatcactggtggttttcttgataccactctctcttgcctcccacatccattcaataattatcatttttaccatttgtttagcatttaccatgagcttttggaattcaaatattatcttttgcagtagccactttgaacttttgtcactattcacgtatgaattaggaacaaacaaaggtagacaagagaatcatgaaaatgtgaaaccaatactattaaaacaatgttgcttttccctggagtgtaattaagtctaagtgcttaaattacgacaatgaaataaacacctaaaacaatctaaacatagtgattctataaaaataatcaaatatgtgccaggcctttaacatttcatcctcagaactatcctatgagttaggagttactatggtctccattttacagttggatcaactgaggcacagagaaattagggaccttcctaaattcagaagactagtaaacagaagagttaagattcaaatctacacaatctgactctatagttaaggctcttaatcactgcattcagttgcttgctaaattaatacatgctgtattttcttcttttttttttttttgagatggagtttcacttttgtcgcctatgctggagtgcaatggcctaatctcagctcactgcaacctccgcctctcaggttcaagctattctcctgcctcagcctcctgagtagctgggattacaggcgtgcaccaccatgcccagctaatttttgtatttttagtagagacagggcttcaccacgttggccaggctggtctcgaactcctaacttcaggtcatctgcccacttcaacctcccagagtgctgggattacagggttgagccaccatacgcagccatattttcttcttttacaatgtatttgttcccatctagtcactttctattattaccttggcacaagctctcattacttcttgccagaactattgcagtagtagtctagccagttcccccgtctctacctccctccagtccatttcatatactttcctgagataaatctttcccaagcatggctaggtgtatttagctgtccttagcctagagaaaaatggagtggctccaaactaattaggcccttgaataatataggaattttccctactacccttcatttatcttgtgatctaagcaaacttaattacttcctgaaacaccattctctttatgtattaatttatctatgcctgaagttgtcagctttatgttcttatttatgtatattattttataattatccatattatacattatcctgtgtacatgtatctctgggacatatagctattgtatatgtgtattgcttgttttccctctgagatctttaaattctctcacatgtaagcatatgttgttgatgtattctgaaaatgttttttatgtgtcattggcgtgattgtgattttacaccataatttcccaatgtttatgtaaacattataggaactctgtatttgaatatgaaactctttatgccattagggcatttgccccatctataccttttctggttcctattttaaccagggacatgaatttgtagcctggccagctatagttataggtattggctacagaacttttttttttttttttttgagacggagttttgctcttgttgcccaggctggagtgcagtggcatgatcgcggctcaccgcaacctctgcctttcgggttcaagcgattctcctgcctcaggctcccaagtagctgggattacaggcatgcgccaccacgcccggctaattttgtatttttagtagagatagggtttctccatgttggtcaggctggtctcgaactcccgacctcaggtgatctgcccacctcagcctcccaaagtgctgggattacaggtgtgagccaccaggcctggcctttttttttttttttttttttttttttttttttttaaacaaaactaactggctcttacaagaatcagactcatgaccttggcctcattagcactatgagctaaccaagtctgacatatagaaattacacaagcgacaactcataagagaaaccagaactgtaagatggccttttggaaataattttcttaaagagcatatccaaatggagaccttcatttagcagcttataacaaattcttgatcgcagagttgcttcattttaagagtgaaaaacaatataacaatagcagtagaaattgaaagcagggaagttttcctgacatattgttttctttcttgtataatgtagatttatttagaacaggggctctaaccacctgtcagtaatatgtttctgtcaattttcctgtagatttttattcatggaaatagcactggtggcaaacatgagctagtgagtgaaagtatcctacacaattccccaaacgcctctgccagtttattttagtgttaatttttagtgcactttttttttttttttttttcagtgtggttggagcaaaacagagattaagagaaaattgctatggttctactggtttggataaatgggacaggtgccaacaattaccactggtgtgacttttccccccaatataagcattactattatgactattttgtttcctccttttacaaaatgccaggtggaatttatagagttcttattgtgaaaactaagacctattcctgattcttttctgaatttcatgactttgggaatatcctttagtttatatactacagttaccccctccataatatggggataccatggtgttaagattgatgtaagaattaatgtgtttaccagtcagtcttctagccaaacaaaaataagacacatttgcacagctttagttgtcagagaggtctggagcaattgttacatcctatatatacttctgcttgtgattttgagggcttagggtatgttgcttcaatcatatttataactaatgctgtatttttttactatttctgattgctaccttaactaaattaattttttcctcataccctgatactaggcatttggaatttagtaagtagctgaaatttgaataaatagcaaaaacggtataagtttttcaggttttttttttttttttttgagctggctagaacagacacatggattgaacatgatatctgacattgttgataatataatgagtaatatcaaggaacggtgaaggaagtgttgtagtttctaattttttcaatatggaagtgaatctactctatgataagtgcaacacagcttatctaatgctacttaaattgaaaaaaaaatgagagttccatgataagatttaaaaagtcatgtttgcaaaactcatttgaatagtcagaagtatagaaagtcgtcattaggcagctcttcatatatttgttactaaatcatctatgcagttacagattttatatatgtgtttttttcacatttaccattaagggactcttagtcctttttttttttttttttttattgaaacggagtctcactgtgttacccaggctggggtgtagtggcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattataaaaatagcgccaaatgtcagtctaaagcaaaatatttttgtatttcaataaaaaaatgaaaattatacattggatgaaatgtatatgactaaagtaaacaggcttttgaaatttaaatcaaggctctttcatagaatctgcataataaatgccatttatagttaatttattctatatgtcatatatttaaaatgcattcaaaatcaaatatcaagactaaattgtactccagttgaaaatccatgacaattttctctttgtctaaatcctagctgatatttgtttattgcacccctttcttttagaataatagaagcttgagaactatgcttggtaatataacaagaaagcatgattatagatataaatgatgtaacaagaattctattcccagttgtgcgttgtaagactgacaaacattggattaatgttgaataggtcatttgcaattctatgctgtttgtagagaaatcatattttgctattcttaggaacttacatatgagtttgttttggaggttttctgaaacatgaaagacataaaaaagacagacttttcctgtagcaattcatggaatacgttgtacattgttcttcctaaactacgtaactctctatgtgaataagacatcatatcctacaagccttacaaactttgactgtccctggacctcttgtgagaataaattaaagatgtcatgtctcatatattttgttatcagtgaggaaaaagaaataacattttctttttcatattttggtagagagtgcatatgattgatagtgaaatacatgcctatagtaactatttgtagttatatatagatggaacaattcagtgacgctttccaactttatcaggacctaagacttttacctttccaagtccaaagtgactaactgtaactctactagtaatttttttaaaaagcttatttaaaaaaaaaaaaaaaaacaagaagaatgtctccggccgggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcatggtggcgggcgcctgtagtcccagctacttgggaggctgaggcaggagaatggcgtgaacccgggaggcggaggttgctgtgagccgagatcacgccactgcactccagcctgggccacagagcaagactccgtcttaaaaaaaaaaaaaaaaaaaaaaaaaaaaaaaaaagaagaagaagaatgtctccatagttattcataacaattgtgaaaatttaagtaattggccgggcgcagtggctcacgcctgtaatcccagcactttgggaggccgaggtgggcggattacaaagtcaggagatcgacatcgcgccactgcactccagcgtaggccacagagcgagactccgtctcaaaaaaaaaaaaaaaaaaaaagaaaatttaagtaattggatgagttgttttcgtataaattggatgtatacgtttgatgtcctcattgtgttcagcaagctaagatgtatatgtacagttaaacatgagtcatgccctctatgatgagtttaaacatttaaaccaaatatttgttacatatgatacattaagtacaaatgttttttatctatggtaccttaatttatataacatatcttaggttataaactgtttgtttataacaacaaataaagcgaagtattcaaaatggcttgtagcaaggtgctgagacatgtgaaggagtgccagattgttcttgataatttacttcccacctctgactcacttttacatggtcagctttcagagaataagcacaaagatgttagcaaaattaagggcactttaaagtttttgttgagatgtttttaagtcttaaacaaaatttcaaatccagagatttgtgggaccaaaatgatgaattaaaagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaataagttagacacttattaaaccttttataaaagtattggatatggccgagcacagtggctcacgcctgtaatcccagcactttgggaggccgaggcgggcagatcacaaggtcaagagatcgagaacatcctggtcaacatggtgaaaccccatctctactaaaaatacaaaaattagctaggcatggtggtgcgtgcctgtagtcccagctattcaggaggttgaagcaggagaatcacttgaacccgggaggcagaggttgcagtgagctgagatcgcaccactgcactccagcctgacgatagagcaagactccatctcaaaaaaaaaaaaaaaaaaaaaagtattggacactcagccaggcatggtggctcacacctgtaatcccagcactttgggaggccgaggtgggcggatcacctgagggcaggagctcaagaccaacctggccaatatggtgaaaccctgtctctacttaaaaatacaaaaaattagccgggtgtggtggtgcatgcctgtaatcctagctacccaggaggctgaggcaggagaattgcttgaacttgggaggcagaggttgcagtgagatgagactgtgccattgcactccagcctgggcagcaagagcaaaactctatctccaaaaaataaaaattaaaaaataaaataaaataaaatagtattggacactcatcctctgaggaggcagtgtaactgggtgagaaaaaactctcttatatatcctttaggtacagctctgatttctgatgataagcttgctataaaacaatctattaaaaatgattctggctgggcatggtggctcatgtcccaaagtcatcccagcactttgggagactgaggcaggcagatcatctgaggtcaggagttcaagaccagcctggccaacatggtgaaacccgtctctaccaaaaatacaaaaattagccgggcgcggtgtcgtgcgcctatagtcacagctacttgggtggctgaggcatgagaatcgcttgaacccaggaggcggaggttgcagtgagccgagatcgcgccactgcactccagcctaggggatagagtgagactctgtctccaaaacaaaagatatctcctataccttgcataagcaaatgatgtgaggaaaacttgcttaattaagatcccaattttgttttggtgcttttgacactcttcatgcttgactaaactttttcattatggatttgcatttcttttactttttcttttcttttacttttcatttcttttacttatatgaataaaaggtctattcccttattggtttgaatttgggttacttggtgtctttggtcagtaaagagaaataatttgttttagcatccaatggattatggtctgcttcccaattgtttttgtttttcaattccatcctgatactggaacaacagatcatcttgtttttgctacaaacaggtgacacccaactatagtttgtgtatattgtaagacatacagagagtgttacaaattcccagtgttttcctctgtttcttagtcctgtactattcaggaattgtttcacacgagccttgataaactagctttctcaagaaagaaggttatgatatgttgttgttttgagatgttgaaattatgttaaattatgcataggaggtattatttatttattgagtttagtgctcccaaactgtattctacagaatattgttctacaggatgttacaataatgttaaaaaagggaaagaaaaagtatggaggtagtcaaggggatcatctgtggcaaataagttgtgaatgtgctgggttaaacaaagacaaacagatctattttctgcagaacttctcatgacttttaatatgctatttttattgtaaatctataaggggctatactataaaacatttctctaacttatttagccatggggtgtgtgtgtgtgtgtaatactttttaacatctcaagtatggcacacagtttgggaaaaggtggtctagctatttgttcttgtatgcaaaaggcatgggtaaaatggacacaggacaaaattgttaaaatgttgtttgtaacatgcctacagaccttgttggcaaagcttcctgattataggaaatccccattgaaatattcagggggagaaaaaaatcaaataggattattttttaaatgcattggctataacaccctgtatgttgaatgtgggaaatagactaattttagctaatatataaataaacagtatggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttggcaaaccagttgtaccctttgtctgaaacactcctgcacttcatctgaatggaaaccctttcatttctgttatgagattgaataaccaggtgattggaggaagactacagttaagtgtgatttatagacaatagattttgccagaggagattttgaagctatgtaaaaattctttttattttttcatgatatttactaaggttttatcgatttcagattcagtctcaatataaaatagtaataacattagtggtacaaatttcattagcacatacttagatgtaagaaatcataggctgggtgcggtggctcactcctataatcccagcactttgggaggttgaggcgggtggatcacctgaggtcaggggttcaagaccagcctgaccaacatggagaaaccccatctctactaaaaatacaaaattagccgggcgtggtggcgcatgcctgtaatctcagctactcgggaggctgaggcaggagaatcacttgaacctgggaggcagaggttgcagtgagacaagattgcgccattgcactccagcctgggcaacaagaacaagactctgtctcaaaaaaaaaaaaaaaaaagaaaaagaaaaagatatcattactatagattagattggcatgactcaaccttctttagaggttagttgtttctactgagtatgtttgccatttggagatctggcatttggggagtatttgtgcttcaggtggtttgaaaggcagatcttataagtttataacattgtcatctattttcaataggtttttgatattgaaaggaatcatttccaaacagtatcactactgtctaaacactgagtagttacacatacatattagcaatgactaaaaaaatactgtttgcagcaaggttggaaagaaatagaatgatctaggcataaaccacatatcttcctaattaaatgaaacagtatttcattgctgcttaacctactcttgtcttacagattgaccttgactcaattccaggtcagaagtcttcccacactgtgcttattaaggtctctggcatttgaaatggcagagctgctctaatcttcaaatcccatcgctttactttgcttgctatactcccttttccctcacttctgtacagcctacaagtcttatgtgttaaaaagcctctgctaaggccaggcgcggtggctcacgtctgtaatcccagcatttttaggaggctgaggctggcagatcacctgaggtcaggagttccagaccagcctgaccaacatggtgaaaccccatcttttttttttttttttttttttttgagacggagtctcgcactgtcgtccaggctggagtgcactggcatgatctcggctcactgcaagctcggcctcccgggttcacaccattctcctgcctcagcctcccaagtagctgtgactacaggcacctgccaccacgcccggcaaatttttttgtatttttagtagagacggggtttcaccatgttagccaggatggatgaaaccccatctttactaaaaattcaaaattagctgggcgtggtggtgcatgcctgtaaccccagctacttgggaggctgaggcaggagatggctcgaacctgggaggcagaggttgtagtgagctgagatcgtgccattgcactccagcctggggaacaagagtgaaactccgtctcaaaaaaacaaaacaaaacaaaaagcctctgctagcagatttttgatcaacattttcttttatcagtggcttgctcaattttatttatttattttttttttgagacggagtctcgctgtgtcatccaggctgaagtgcagtggcgtgatcttggcttactgcaacatctgcctcctgggttcaagcgactcctgcctcagcctcccgagtagctgggattacaggcatgaaccaccacacctggctattttttatatttttagtagagacggggtttcaccatactggccaggctggtctctcgaactcctggcctcaggtgatccgcccacctcagcctcccaaagtgctggaattacaggcatgagccaccgcgcccggccaattttacattttttatacccaattttcattgatgcattctcaagacttaaataataatgaagtgcctgcccatatgtaatatttcctgatactccatgggctttagcggtaaggtaactttgtcatataagaacctaaaataactgtagttacacttttaaaatagcttgttttgctagtgttgctatagaaaatgctttataaataacatttcaagaactgtgtttctctgaatctccttatcgttgccagaatgtttcccagtaacttatctgtatctacaaagaaagtgctatgtttagatactggtcagttctaagtcattttcattgatgacaacattaaatataagttatacaaaatagtagatattccaactaaaattttatctcttctttgtgaaggatctgtttcagtccttaagaaatagagtcatttgaatgggaaaacctagaaacagttttaaggcccagggtatggtgaagtcaccaacctgtttcttctctgccagttctaatcttgacataacaagaaagttactggacaatcaatcatgacctttaggggtgtgggggaaggaaaagaaaagacaagtttaggcagctcctctatttctaaagaatgtcatagagaaatttaaagaaatccttgctatactttacctggccccctcctggattaactcatgaggcaaatgagatttcctcactctgaatttgcaaagcgacaaaatttccaccaaagaatcagcatgaatgggatttgaagaatggaataaaaagtgaattaaattactgatcaccctaattttcaatactcattcattcattcagcaaaaatttattaagtgcctcctaatctgctagatagtgttgtaggttctggaaataccatagtacacagataaacatttctgccttcctggagcttatgtaatagtaaggaaaaacagatgaaataaagacattgcaaagtatgttcaaaggcgataaatgccatagggtataaaagtgaagagggagtttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagagtcgtagaagataaggtaagaaaaattgtgaggggtggagggagttgtacacccaaatgatatagaaacttatggatctgccgggtgtggtggggtggctcgcgactgtaatctcagcgctttgggacgctgatgcgggcagatcacttgaggtcaggagtttgagaccagcctggccaacatggtgaaaccccatctctaccaaaaaatataaaaattagccgggcatggtggcaggcgcctgtaatcgcgctacttgggaggctggggcaagagaattgcttgaacctgggaggcggaggttgcagtgagccgagattgcgccattgcactccagcctgggcgacagagcgagactccatctcaaaaaataaaaaaaagaaaaaattagaaaaagaaacttgtgggtcataataaggacctgagctattatttaaagatgagaagccattgaaaggttttgagtggaggagagacatgcactcagttaggtacaaacagaatcaccctgaataatgtgttaagaacagactgataagcaaggcagatgggaagcagggagacccataggaagtaattgcaataatctaggagactattgcagtaatctaggctagtattagtagaggtgatgaaaagtagccgaatacctagatatgatgtaaatgcccagtgggttcaccttgccagctacctagacagagctgatttatcaagataggacagttgcaataaagaaagagtaattcactcagagccagctgtgcagtacaccagagttttattactcaaatcagtctccctgagcattcggggatcagagtttttaaggacaacttggtggggggaagcctgtgagccgggagtgctgattggttaggtcagagatgaaatcatagggagtcaaagctgtcttcttgtgctgagttagttcctgggtgcggggacacaagatcagatgagccagtttatctatcagggtgatgccagctgatccatcaagtgcagggtctgcacaatttctcaagcactgatcttaggagcagtttagggagtttcagaatcttgtagcctccagctgcatgactcctaaaccataatccctggctaatttgttagtcctacaaaggcagtctagtctccaggaaagaagggaatttgccttgggaaatgccgttatcatcttttttttttgggtgggggaggacagagtctcgcctgtggcctaggctggagtgcagtggaacaatctcggctcactgcaagctctgtctcctgggttcataccattctcctgcctcagcctccccagtagctgggactacaggcgcccgccaccaagcccggctagttttttgtgttttttagtagaggcggggtttcaccatgttagccaggatggtctcgatctcctaacctcatgatccgcccacctcagcctcccaaggtgctgggattacaggcgtgagccaccatgccggcctatcatctttgttttaaactataaactaagttcctcctaaagttagttcagcctacgcccaggaatgaacaaggacagcttggaggttaaaagcaagatgaagttggttaggtcagatgtctttcactgtctcagttacaattttgcaatgctagtttcaatgtcagtttgtaccatatgaaattgccaatatttgatcacttttgatcaatagaatcctttttttttttttttttttttttttttgagatggagctctgttgctcaggctggagtgcagtgtcatgttctcagctcattgcaacctcctcctccccagttcaagagattctcctgcctcagcctcccgagtagctgggattacaggtgcctgccaccacgcccggctaatttttatatttttagtagagacggggttttgccatgctggccaggctggtcttgaactcctgatctcaggtgatctgccgcctcagccctccaaagtgctgggattacgggcatcggccagtgcacccggcaagaatccataatttctagtggttctttctaactttttgaaagtagaatggatagaagtttactaaaattatacactagatgtgtgggatatgagaggagtgaaggaaaattcccaaggcttttgagctaagcacatggtaagaatagagttgtcattaactgagacaatggagagcccatggctattaattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgataatgtactttcaatagaggtcacagtatttgtctagaatgagttaaagataagagtctatacctttgctgtgactttatctttttgcctgactagtgtctctttgatatatatctttctatactgtaggggctgatttcttctgcgtttgaatttatgaggcaaatagaattggactgaaaaggtgttagagaatttagagaaatacttaaatgaatcactcagtttgtttaaatttagaaacaataaaagctgtttgttcaggctactattttcaagataccatgttgtgtatgagcataaatagtgccccaggttgctggaaggcaggcttggttttgtttttgagaaatgttttagttgaacaatttttaaaagaagaattgatccacatgtttaacatttcactcccccagaccagcctgggcaacatggtaaaacaggaaaggaagatgagaaataatattctcctattattatggaaacatacctttaatatatggccattgactgaatgcttagttttacttatcattctccttttttgttagactcttagccttcttctccctgcccttaaagaccctataagagagaaaaacaggtatacaagtcagttgccatggtgcacaactgtagtttcagctattcaggaagctgaggcatgatgattgcttgagaccaggagatctgggctgcagtaacgatcatggtgcctgtaagtagccactgcaccctagccttggcaagtgagaccctggctcttgaaacaacaaaacaaaacaagtacacaaataaagcaagtaatataaggcatgatatggcgtaacagagatgcttttgtgttttaagcatttttactggagattaatgagtggatgtgaattttaaggtgtgctccaaggtacccaaggggtttccatcaagatgcatcagaggttgctgatgggattggaaacttatcccctttacccccactcctctacacacatgctcacacagagcagctccacttttatctgttttataaattgggtttttgtgtagcactgtgaaaagaaagtgttctttttgtttgtttgttttgggttgggatgggtttgaaagtgttcttttaaccattttttttttttttaaaccacagctgtaatagaaagaacacgagctttggagtaagaaacatctgagttgaaattttagttttgctcttagatgatgcttacctcatccatcaccataagctcttccttgtttctcaattttgatcttcattttgagtatcaaatgagagatgtgtagagtgcctattgcattgactgatcaaggattcctgttagattggaaaactgtgagttctattaaactattttttatatcatagatattattttaaaaccttgagaaaagcaggttcacatatttattaagccgatgattacattttttaacttagcccaagtttctttatgtaatttggcctaaatatatctgagatcctttaagccatctatcgatatttgtacttgatcatcgcatcatagtgatctcacgatgttgagatgttcaactcctgagcccttggggtagccagtgccctctagcgggttggtttgccttagcaaccttgagcagccttgtccgtttaccctagtgtgccatgtaaataatatcatttcctaaatatgccgtgaagacattgatttaaagaagcatagatgatccttcctgttctgtttttctcctcctctgttctttctcttctcactttcttgtcttcaaatcccctggtttaaggccaaagaaatcagtagactagccgagcgcagtggctcaggcctgtaatcccaacactttgggaggccgaggcaggcggatcacgaggtcaggagtccgagactagcctgaccaatatggtgaaaccccgtctctactaaaaatacaaaaaaaaaaaaaaaaaaaaactagccgggcctggtggcgcgcaccagtagtcccagctactcgggaggctgaggcagtagaattgcttgaacccaggaggcagaggttgcagtgagccgagattgtgccactgcactccatcccgggccatagagggagactccgtctcaagaaaaaagaaatcagtagactagagggtaggcagcataagcaatttgatgatgggagacagtccatttctttttcctgtacctcaagccctatttagatagactttatttacatattaaggaaaaaaaacatgttttgacaagttgactagtttcctcctgggtttccattttccttgagcaaaatctgcaacagtctcatgtagatggggtaaatgggtttatgtgtgggggtccatgccacatgaagaagttagatgtgcactagcttccataataggaacagcaagaattgaaacagaaaggaaatagaaaccagtgcagggtgtctaggcaagatgagaaagcaaattgcttggaatatgaattgcatgatgactattgtaatgcttctattattttctgaaaagtaagaatgtctttatgttgagcttgaaccagaaggattactgagtccattctgtgttcaatctgtaaagaaataaactaaaacaggtgaacattgaaaatgttacaatgtcataatttgttttttttagcccaatcaccacttttctgattgcaaagtaagtccttcagtcaaatccattgtttgtctgtggttcttatgattaacttccttaaactcaaataacgtttgaaactcaacattttaaggatgtttttaaataagcattattctaacggtgcaaggacattttttaatgccttgccttctcttgcctaggaaatagaaggcagaattaagacttgaaacatcattttcctttcttttaagtgatgattcagtattttagttgattgtaaacagacattcctcttttgcttatgattacctgatgataattcaagttaaatcattgagataataaatctcatacattgatttgatgagagaaatcagtgttaacgccaaaccatgttgaaattggtcttagagatataagccattttgcaggagtgtgtttttgactaatcatgccagagagaaattaatcgaattgtggaatattacactttgcattcatgaaagaatgtgataatgccactactcttcaaatgcatgaatgtgactgaagggaacagtaattatctgcattcctttctactttaggagccagtgtatcctgaccttgtccgtgattgtaatcaccgtaacttgattagagattttttaaattatttttcaattgacacattttaatttatttatggggtacaatctgatgttttgatacatagctatattatgatacaaccagtttagctagtgtatccatcacctgtgcatttatcatttctttgcagtgagaaattatataagatacaatattttactgttaaacatagttaccctactgtgcaatagaacaccaaaatttattcttactatctaattgtaactttgtacctattgaccagcctctctccatccttcccttcctcttcccctctccagtctcaaccactggtctatccttttttgtttgtttgttttttgagatggagtcttgctctgtcgcacaggctagagtgcaatggcgccatctcggctcactgcaacttccgcctcccaggttcaagcgattctcctgcctcagcctcccgagtagctgggattacaggcacctgccaccacacccggctaatttttgtatttttagtagagacggagtttcactatcttggccaggctggtctccaactcctgacctcgtgatccaccagcctcggcctctcaaagtgctgggattacaagcgtgagccacaacgccctgccgcccactggtctattcttgattacagttttctttttttttctttactttttttttttttttttttttttttttgagatggagtttctctcttgttgcccaggctggagtgcaatggcataatctcggctcactgcaatctctgcctcccgggttcaagctattctcagcctcctgagtagctgggattacaggcacccgccaccatgcctgactatttttgtatttttagtacagacaaagtttcaccatgttggccaggttggtctcgaacccctgacctcaagtgatccacccgccttagcctcccaaagtggtgagattacaggcatgagccaccacgcccggccgattacagttttcaagatgtcatgtcatccttgctgttctaaacatcacccaaaattggagaaagaatagtggtaaaacagtagcgacattaaacttaggtaaagcttctcagtgatattattaatagaatcagaaataaatgacgttttcttataaggattcaaacacagaaaatcttcaagaaataccagtagctgtattttttttcccttctgagccaaaggttagattgggaggactgtattttgatagactccttacgacattttaaaataaattcttcagatctagaaagttgactctgaatattttccattcataattttgagaattttctaaaattgatgagcaaacagttatgcagtaagaaaaagattgtatagaaattgataatttgttctctttccatttatcgctgatgctccctttctcacttctacaaataaaaagtttcaaatctttgttctttgtctcttccatggcaatatagaagttataaggtaataaatcaaatttggaaaaagatcttttttcctactctaattgtagggctttaactcttatagagaatcagaacgttaaagtacttctcatataaaattcccctttttttttttttttgagacggagtctcgctctttggcccaggccagactgcagtggcgctatctcggctcactgcaagctccgcctcccgggttcatgccattctcccctcagcctcccaagtagctgggactacaggcgcccaccactgcacccggctaattttttgtatttttagtaaagacggagtttcaccgtgttagctaggatggtctcaatctcctgacctcgtgatctgcccgcctcagcctcccaaagtgctgggataacaggcgtgagccaccacgcccggccaaaattcccataatattatttcaaaatagaattagtgcctagtataacacctagtactgagtaggcactcagtcagtatctgtgtaggaaggaatagatgggacatgataaatataattgataataaatattggccggttgcagtggctcatgcctgcaatcccagcactttgggaggccgaggcaggtggatcccctgaggtcaggggtttgagaccagcttggccaacatggtgaaaccccatctctactaaaagtacaaaaaatagccgggtgtggtggtgtgtgcctgtaatcacagttacttgggagactgaggcaggagaattgcatgaacctgggaggcggaggttccagcgagccaagattgcgccattgcactccagcctgggtgacagagtgagactctgtctcaaaaaaaaaatatatatatatataattgataataaaaattgataatattaaataataataatattaaatatactcttgaaagactatgtttttctgctgctagacatactactttgtaaccaaaaaagcatacttatttgtttttgtgaaacattcacaacataaatggttaaacagcataaaggaccgtatgtttgagtgttacctctaaattaactaactgtaggcactgaaggatttccatgaacacaggacttttagtactaaaactagggggtctatcccaggcaaactagaacaaactgatcacccttaaaattatctctcaatttggccaggcgcggtagctcttggctgtaatcccagcactctgggaagccgaggcgggcggatcacctgaggtcaggaggtcgagaccagactggccaattgtggtgaaaccctgtctatactaaaaatacaaaaattacccacacgtggtggcgggcgcctgcagtcccggctgctcaggaggctgaggcagtagaattgcttgaacccaggagactgaggttgcagtgagccaggatggtgccactgcactccagcctgagtaacagagcgagactccgtctcaaaaaaaaaaaaaaaaaaaaaaaatctctcaagttgaggctgccttgaatgtaggttaagctttctggataacttcttacattaaaatttttggataatttacattacaaactgagtcaaatgaaagatcttttattttacttgaaatatataacatattcagcatagaaggagtaaaaagaaaagtataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaatgaatttacatgtcattgcattcagatttacatatatacatatgcatgtacgttcacatacattcacatatgtatgtgtttttgttgttgtgttgttatttttttttttttttttttttttgagatggaatctcgctctgtcccccaggctggagtgcagtggtgcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtctgggagtctatctgaatctactgattttgattagtttttaaagaatgaaaaaacaaacaaaaaaaaaccctttcacatgaaacctaccactcaaaatttaagttggattagagatagtgctttgagatttccttcctgactaaaaagtaggttgttgatagcaaaagatcttttgcaactctagtatttgctgtaaactatgatatattcctacaagtacaaatagaaatattttaacatttattcttaagtttatcccagttcttttttttttttttttttttgagagaagtctcactcttataccccaggtttgattgcaatggctcaatctcggctcacttcaacctccgcctcccaggttcaaatgattctcctgcctctgcctcccaaatagctgggattaagtcgcctgccaccacgcccggctaatttttgtatattttagtagagacggggtttccccatgttggccaggctggtctcgatctgctgacctcaggtgatccgcccacctcagcctcccaaagtgctgggattataggcatgagccaccgcacccagcccctgagcttactttttaagaactggcataggccgggcacagtagctgggattacaggcgtgagccactgtgcccgccctatgccagttcttaaaaagtaagcttggccgggcgcggtggctcacgcctgtaatcccagcactttgggaggccgaggcgggcggatcacgaggtcaggagatcgagaccatcctggcgaacacggtgaaaccctgtctctactaaaaatacaaaaaattagccgggcgtggtggcgggcgcctgtagtcccagctactctggaggctgaggcgggagaatggcgtgaacccgggaggcggagcttgcagtgagccgagatcgcaccattgcactccagcctgggtgacagagtgagactccgtctcaagaaaaaaaaaaaaaaaaaaaaagctcagggaccgggtgcggtggctcatgcctgtaatcccagcactttgggaggccgaggtgggcggatcacctgaggtcaggagttcgacaccagcctgaccaacacggagaaaccccatctctactaaaaatacaaaattagccaggagtggtggcgcatgcctgtaatcccagctactcaggaggctgaggcaggagaatctcttgaacccgggaggcagatgttgcagtgagccgagatcacgccattgcaccccagcctgggcaacaggagcgaaactctgtctcaaaaaaaaaaaaaaaaaaaaaataagtaagctcagaaaaagaggctctttataggctaaatcaaataacttgttgaacctaatttttaaatttggctcttatttgtgtactcagtatttagatctaatttgactctgataataaccaactttaagtgaagcagctaccctttggtgcctacagatgactctcctttcaataaaacatatttaaatagatgacagtgatattttctatgatattcccattcgagaagccccttgctgtggttctggcaaggcttccacagcaggtgatgtggggctcatgagaggagtgccttacttactcctatagaaagctataataaaaggagcaaataaatacctcttgtagctaagaatctgatgtaccacttaatattttcaggtggcaactgcactgtcatttcatataaaattcctttcattagctataaaaaacattgcctgcctgccagctgtttggaaagcatcgtaagatcaggaaaatgacaaaacagcccctcattcgcagtagatacaatgaactagtcaaatagtacatttttaaaatctatcttttgcaaaaagaatttttgcttttcatctcatgcgtttttgtttttaatgacggcatctcaatttttgttcttgtttttttctatctaagctaataaacagattgtgatagtctgtactcaaacacaaaggttcaagagatctggaagaacctgcatatagtagagtataaaaggcctgtgcaacttagactcaaatgtatcaatgcctacaggaaaacaccacaggtcagctctttgtatattctctagtcaggtaatgataacctaaactatctctatgagactgctgaaaagttatcgaagtaaattatttttcttgtcttttttttttgagatggagtctctcttgctctatcgcccaggctggagtgcagtggcatgatcttggctcactgcaacatccacctcctggttcaagcgattctcctgcctcagcctctcgagtagcttggcttacagacacctgccaccacacccagctaatttttgtatttttagtagagacggggttttgccatgttggccaggctggtctcaaactcctgacctcaggtgatccgcccacctcggcatcccaaagtgctgggattacaggcatgagccacctcacccggccaataaattatttttcttaaacatgtatcattcatcttagagtgtagaaacattgaccctggtgatgaccattgttatttgtgcacatggctgtggatgaagaggtaaatgaacagcctccattgtccactgcctgcgtgtggaggaggctctgtggttggccttatgtctgatgagtgcaatctgcatctgcaactctgcttcttatagccataatttgcctaatagtattgctcaaggagagaaaatacatatccatatcttcaggaatataggaccatctggtgagaattacttttaatggctacattgaatattagtagttgattgttaatacagagagtaggaaggacattataatgctcaatagttgtccagtctgggcagttactcagctgtcttagacaagaccaagttttgccttttttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactctgcatgattgattagtatccttttgctttgcaaatgtgcatatattaagttcagcattgcagtttgcaaagattcactcatggcctgccatggtaattgatgcacacctgtcctagggagcaatgtatgagtttttttgtgctttcacataagaagtctctggagtatttttaattggtcatctctagaagagggaaacaggagcagattaaaagtatacaggaaaaggaggttgttctacaagcagtttaaaaatctatttgaaaaagatccccaccacttataagctgaatagttataattaatttgtatccctgcattctaaaataagagtactcaacaggttttatttttatggacaagtatctgtgggcttaggaaatttctttctttcttgtcttttttttgaagatggagtctcactctgttgcccaggctggagtgcagtggcgccatctctgctcactgcaacctccgcctcctgggttcaagcaattctcctgcctcagcctccaaagtagctgggattacaggtgcctgccaccccgcccggctaatttttgtatttttagtagagacagggtttcaccatgttggccaggctggtctcaaactactgacctcaggcaatccgcctgcctcagcctcccaaagtgctaggattacaggcatgagctaccgcgcccggcctaggaaatttcattgttatttattgttgtttttgttttgtttttatttttgtttgagacagtctcgctctgtcgcccaggctggattgcagtggcacagtcttggctcattgcaacctccgcctccccagttcaaacaattctcatgcctcagcctcctgagtagctggaattacaggtgcctgccaccacacctggctactggctaatttttgtatttttagtagagacagggtttcgccatgttggccaggctgggctcgaactcctgacctcaggtgatccacctgccttggcctcccaaagtgctgggagtacaggcgcaagccactgcacctggcctaatttttgtatttttagtagagacggggtttcaccatgttggccaggctggtctcaaactcctgacctcagatgatctgcccgtttctgcctcccaaagtgctaggattacaggcgtgagccaccacacccagcctgttatatgtttaaccctttttccaagttgacatttccctgatactttggctttttaaatagcatacccttccccacaattcatttaatgaatcccttcttaatttacttaaaaacaaagatgttcctccagaagcaaccagtttttttctgtattgtttagggattgtgttttctggttttgtaatagtatcagaacatataggtaaatattattttggagtctagtttaatcagatcactcttttgctatagaaatatgttactagcttcttaacggccaggcggagtgtctcatgcctgtaatcccagcactttgggaggctgaggcaggtggatcacttgaggtcaggagttcaagatcagcctggcaaacattgtgaaaccccatctctcctaaaaaatcaaaaattagccatgcatggtggcgcacgcctgtagtcccagctacttgggaggctgaggttggagaatcgcttgatcccgggaggcagaggttgcagtgagctgagattgcactactacactccagcctgatacagagtgagactctgtatcaaaaaacaaacaaacaaacaaacaaaaaacaactatgttattagctccttaaattataagtcatttcattgctttctctggacctagcatctatcattgctcttgtttacatctcagtaaacatctcagtttcaatctgatttagataaatgtgattttttaagctgaaattcctaaatcagtagtaagtgtgcaaatattttaaagattatttgccatatgttattttagatacttatccctatttttctgcttttaattagaaaaaataatttataaactggatgatgttaaaatatataaataatttattaatttcattcataaaatgagctctaatatatatacttcttatatttctagactaatatacagccacattcatcattttttcctagtacattagtatttttatctaaattaattttcacccgctaatgaatattaggaagcactatacatcattaaaagtatttattccaagatgatttccccaaatgtgttactatgtaaacatactctgtttacccctccctttccatcaaaaatagccttaaggcatcatgataaaaatgatactgtatttatggacaggataaatcaaacacagtgaagatgaaagaatcagattaggcattccatttgcttactcagtatggtttctcttatgcccaggtttccatctttacagaacttattgggcatgtttcacccacactgcaatgtaactgattttcttttctctgccatctgctgttcagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacactggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacacacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccacattttctttattccttgaaggacatgtagattctttcaacttcttggctcttgtgaataatgctgcattgaatataggagtgcaactatctcttcaagatcctgcctttttctttttttcagtccaagagctggctttgaataacacattgacattgaaatatatatggttcctaagatcatgtaattttttgagatgtcagagacacctagagacagcaaacacattaaagatagattcacagttctagtttatatccatgtcacaaactgaacactactgaagctattttgttattgtttgttttcctcaagcagaaaattttcacagggcacatttttgtctctaacaaaggaaagaaaagaaaagaaatgtgttctttggaagtaatgccactgtattcaaatagcttcttccacataaagctaaaaatgtctttcagagttaaataatgcagtttcatatttaagacatacattaaattgatactaggaaaaaaacacaaaatccaccagtgacccagtaaaattagtaaattcttaatgtatgtataagtatatacacatacatacctacacgtacacagaaatgcatatattttagggaaaccttaaaagagaaaaggagttgctgaacagcttaggaaatacagtacaaacaaaaagcagtattgtctgcaaaaaaatttttgttgcaaaagtaatattttccttgtggaaattctggtccagagttgggctattacctatattgaataaattcagggaaacattctgaaatgtttgactgctatgattgaagtattatattaaagtactttatatcgtgaaatgcacttgttttcaaccatgcaaacagttttattaagtaggaggatatcagggttaaggttaggtttacatgaccatatgagaaaatttatataaggtgatggcatgaatggattctgatcttcaaactagacaactagaagttggaattctaatgtcaggggtatcaaacagcccacatggaaaagaaatgagagtctttaataagcaattgggttagaaaatatatagtatttcaatgtcattattttatttcagagtaacatgtctgtcattgagatagtttactgtaggttaaattcagtatgaggttgccatgtacttgcaaggttcttaaccctgttttagagatcataagacataaaagtgtgcaaaatatattcattctagaatagggagtttcctacactaaacaaccagcttaaataatatattcaagtgttttcatgagaaaaaaatcaaaatactttttatcaagatgttagtgctttcattttacctgaatacttatagaatctagcattatacagctggaaggaaccttgcagaatttctactcaaattgctttattttgtatctgctgtgagggatgtaaattccacagatcatcttgtatatatataaaaagggctaaatctcttgcctcagttcatagatcttttgaatgcacagaattggctcttatctttattagtaaacttgatttggaagacatttccttttttgttgccacttctttacctcattggtgattttagttaagtaagcaaagataaacaagaagtggaaaagcagtatcagctgaattgaaaccactacttagattgaaaaagcatgattggacactatctataattcagtataattctcaaacctaaaatgggacatttgaaaataagtgtaggaaaaatacttataaaatgggaaaaatggaaataaaatgtccaaagaattcagaaaattatactaaagggtccaatcaaacccaaatatgtacatattcattccaaaacaacagacatatcagaagtacctggtaccataaaaattaaaatacacacacactcacaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatcctatatttggggggagtatatcaaggccaagcatattcggactaaaggaatgtccactgaaccaacaagaatgttaagggagccttgttaaagtactgtcctgatctcgatccgattggctaagaggaagtcttcctgtccttgctccttgtacttcttactgctttgtacttcttactgctgccatgcaacctgatctccattttatcaaggagcctatatacttcaactgcctattagatttcactatcccagtatttcacagataccacaaactcaatttgtctaaaactagtcattattctctgcccccaaaatagtgctcccttacttgtttctcaagttctgataaaacacaagctcacacaaaacatactaagagtcacccaggctgtaaaactcaaggggtattgtcaatattcccctctctctagccactaatatctagtcagtcaccatgttccatggattctacttccttcatattccttttttttttctttgagatggagtctcactctgtcgctcaggctggagtggagtggtgtgatctccactcactgtaacctccgcctcccaggttcaagcgattctcctgcctcagcctcctgagtagctgggattacaggcatgcaccaccatgcctgattaatttttgtagttttagtagagacggggtttcaccatgttggccgggctggtctcgaactcctgacctcaggtgatccgcccgcctcggcctcccaaagtgctgggattacatgcgtgagccaccgcccccgacccatatttcttatatctatcccctgctttccatttgcagtactgttctgttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggccgaggcgggcggatcacgaggtcaggagatcgagaccatcctggctaatccggtgaaacctcgtctctactaaaaatacaaaaaaattagccgagcgtggtggcgggcgcctgtagtcccagctactcgggaggctgaggcaggagaatggcgtgaacccgggaggcggagcttgcagtgagccgagatcgcgccactgcactccagtctgggcgacagagcaagactccgtctcaaaaaaaaaaaaaaaacaaaaaacaattctagatacattgagacctttgctcatgctattttcattgcctggagtgtcttctctctggatagaaaaatcctttccatacctcaagatggaatttggaagttacttccttgtgaaacttcctaatgattccaaagtcaggcctttctatgtgaaatttattttaccacatgctagtttaaaaaaacaaaacaaaacaaaaaaaaaaacagagcaggcacggtggctcacgcctgtaatcccagcactttgagaggctgaggcgggtggatcacaaggtcaggagtttgagaccagcctggccaacatagtgaaacgccgtctctattaaaaatacaaaaaatagtcgggtgtggtggcaggcgcctgtaatcccagctcttcaggagactgaggcaggagaatcccgtgaatctgggaggcggaggttgcagtgagccgagaacgcaccactgcactccagccgaggcgacagtgcaagacttcgtctcaaaaaacaaaaacaaaacaaaaaaaaaaaaaaaaaagaggaagcaaactatgggctaaacatgctggtttaaaacagttttgtctgaatccaccacatactatctagatggcgatgaaaaagttagttggtctccctgaggctaatttcatcatgtgtaaaatgtagttaataatagcatatataggccattgtgggggttaaataagacaaagcttgttaagcatttagttcaatgcctgcttccttgtaagagttcaataaacattagtttctgctactgaggctctgctgttacttatcgtctcctaacactagtttataaattcagtgagggttaggaaccatgtcttatcactttactttctttttctctatttaatctctagcagtttcttatatattatcgcagcatgataaatgatgctgagaactgagtgtgaggtagggcttggggtaggaccttatctaattaacatctgtgtatgcctaccatgaatattaaataataatactgacattccaaaatatacacatcaatctcaaaaatgtttaaccataactcctgtattccggtaaacacaactatatggcaatcttaatagttatgtattgcctaacacctgttattttttaactgcctttgattctgtgtaacattctcaataatttatcaaatgtactttaattggatatttacatactgcatactcttctcattagtaggaactagcaaatagacttactatcatttagattgtattctatgcttcatttaaattagtctgagagtttttggttgttgttagtgtgtatgtatgtgttttaatttaggcaccattttttataccttaagcaaaggaaatctgatcctaccacttctttgtttaaaccttgtcaatgacttacgttttgggcaagaaagagttttaaatgcttaatagatctatagaatctggttcctgcttacctcaggaaccatctccttcctcactcccacttaactccgtagtctctagtattctaggcctttttcatcttctttgtgttcctagaatatttaatatccttccaagccttccctcatactaccacaatactccttgtggctcttaccatccaggtttgagttttagtgcgtcatctttcaagaagcatttccagactcatggcctacccctgtcccccacaagtctattaagtctcccaaatatacattcttataacaacttaagctttgcagtcacacttttcttttcttttctttttttttttttttttttgagacggagtctcgctctgtcacccaggctggaatgcagtggcacgatcttggctcactgtaagctccgcctcccgggttcacgccggttctcctgcctcagcctcccgagtagctgggactacaggcgcccgccaccacgcccggctaattttttttttgtatttttagtagagatggggtttcaccatgttagccaggatggtctcgatctcctgatctcgtgatccgcccgcctcggcctcccaaagtgctggtattacagttgtgagccacagctcccagcctgcagtcacacttttcaaattgcaatttaaaaaatgttttgtatttgtttaatgtatattttccccactcaactgacatctccttggaaagcagtaaccttgtctgaatattcactactccgtcatcagcacctagaagatacctggcacatagtaggcatttaatcaaaatgtttgaataaatgagtgaagaaatcactctgctgggtgactaaggatgcaaagctaaactctgtcttcgaaggaaggataaaaagacagacacataaaagacaagagagtgaataaagaaagtgggtagagaaaattaagagtgctgagtgtacttcttatctctctaataactaccacatttgtgactttaacaggaggcttatttaaaagcattttttttatcctagctgactcagaccatttatggaaaagtggggtcattgcagaatgtttttatctttctggtagcataattacctcctctatgttaaaaactgaggactttggttcaaaatactcaccactgactatactatctttgttatattatttaaatgtcctatgcctcgattttctttctttcttttctttttttttttttattttaacaagatctactctttaggtagtgagagagcactaagaaaatggctactccaatggggcaggaggtaaaaaagagaagcaggggtacttgatatacttcggatagtacaaatctggtgattctgatccccagaagggattatggactgatatggtttgtctgtgtccccacccaaatgtcatcttgaattgtagtccccataatctccacgtgtcatgggagggacccattgggaagtgattggatcatggggacagtttcctccatgctgttttcatgatagtgagttctcatgagatctgatggttttatcactgtctggcatttcccctgctggcattcattccctcccctgccaccctgtgaagaggcgccttccaccatgattgtaagtttcctgaggactccccagccatgtgagactgtgggtcaattaaacctctttcctttataaattacccagtctcaggtatttcttcataccaacatgagaacagactaatacatggacgtaaccccacattgggtgtcagaataacggaaaaggtgtaaaagtgaggtgactgattctcctctggaaggtttgcagggaggctgtcctagtgggctgccaccaggatagttgctactcacctgtgtcctggcctggtcctggctgagtcctcacccaaactgctctgatgggtggcagtaatgatagccatgcctcagttttataatctgattttttttttttttttttgaaactgagtttcgctcgttgctcaggctggagtgcagtggtgcaatctcagctcactgcaacctccatctcctgggttcaagcaattctcgtgcctcagcctcagaagtagctgagatgacaggtgtgcgccaccacgcctggctaattttgtatttttagtagaaatggggtttcgccatgttggtcaggctggtgtcaaactcctgacctcaggtaatctgcccgcctcggcctcccaaagtgctgggattataagcgtgagccaccgtacctggcctataatctgatttttaacagaatttttttagtctatatcttgaactattttaaagtattatgttgaacccaaatgaaaattaatacatgcattccatattatccttgttaatgcttcatatttgtaaatacttgtcaatgcatattcatcacataatgtgtggtttgtaagtttcacatattttaatattatttttaaagtacatttctttgaaatgttaataatttctaactaaaaattatccaaattaaatggaaaaattcatgttttgtttttagcattaagaggaatcttttctgacaggttttaaaaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggcttttaaaatgaaaattataagtaactaaggtactacctatgaagatgaaaaattgtagcaactgatttgactcaagtatctatgagctctataaactcttcatttcccagtgctctgctaatgcttattctaattctaatggaacatgttttttgtggtaacaattactccttacatcaaaattaagtaaaatgataaacagttttctacacatagcattgatgaagtgatcctactttaccaataggatcagttagagggcaagggggtataacacctgccttcagctacctgaaatagtcaaaaccaatataaatgtacattaaagtataaaggaaataacttactttctattttggtataagcttatggaggaattacaactatctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagtgtcctgttctttgaagcttttgtagttgttgtcactctctcctgtggcaccaaatgccaggaaatctgggtattcaggagcaaatgccctttggctgctgatcgtaccagtgccttcagtagtttctcagggaactgtgttaggagaggttctagcattagttatatagtgtgtccataaccagctttcccgtgtcaccctaaatatggccataggcttctccctcagtgctgccaaaacacaactaagggcaggctgcctggccgagtcacaccaatcataatggtctacaatacactttcttaagtctcagttatattcagtcttaaccccaagtgaggagtaacagtaacccagatcaaatctctactgatgaaacaagctttctcctccttctccatagacaaggtcctgttaaagatatacccactttatattataaatagaaatctacaggtagctgtaaagataccttgtatctctacgacatgaaaatgtcattctgtttctagaatcaaaactgcctgtaagccaccaaatagccttgctggttttttgttttattgttttttttgtttttttttttttttgagatggagcctcgctctgtcgctcaggctggagtgcagtggcatcatctcggctcactgcaacctctgcctcccgagttcaagccattctcctgccttagcctcccgaatagctgggattacaggtaccctccaccacatcctgctgttttttgtatttttagaaaagatggggtttcaccacatccaggttggtctcgaactcctgaccttaagtgatccacctgccttggcctcccaaagtgctgggatttcacgcgtgagccactgtgccctggcaattagcctttcataaaatgcattttatagtaagtttttttttttttttttttttgtgaggcatcccactacatacatttaagtcttatttctactgggtatggtggtagatgcctgtaggcccagctactcagaagactgagatgagaggattgcttgagcccgggagttctgggctataatgcgctaggctgattgggcatctgcactaaggtccacattaacatggtgacctttcagtaacgggggaccactaggttgcttaagcaggggttacctagcccaggtcagaaacaaagtaggtaaaaactctcatgctgatcagtagtggaattgcacctgtgaatagccaccacactccagccttggcaacataacaagattctgtctcttagaaaaaaataaaaagacttattttctttaaaccgtattcttaatttctattctctaatataggagataaacaaaatggccagttttaaattttatctattgtattagggttctccagagaaaaagaatatatatatatttcttttttatataaaataagaatattttatacatctatatatagagagagagaattatggaggctgagacatcttgtcatctaacctccaagcttctgcaagctaaaaaaccaggaaaactgatggtatagttccaatacaaatccacaggcctgagaaccaggggagccaattgtttatgccccagtcccagtcccttggcccaaaaaccaggaatgtcaatgtcccagggcaagagatgatagacggctcagctccagaagagagagagagcattcacccttctccactttggtgttttatcttggccctcaacaaattggatcatttcccaccctcattgaggagggtgatcttctttactcagtctactgattcacatgcaaattcttccagaaacaccctcacagtcacacccagagacaatgtttcaccagctatctggacatcctttaactcagtcaaattgacataaaattaactattacatctactaaaatatctactagagcaacattcaggtctaaagacacaaacttaatttaggctgaccatcattctactgataaacatattcactattacatatatagctttaaaataaatatgattgaagccaaccttgttattaaaatgtatttaagatgttcagattgatgaaacgaggggattaaaatgcgttctcaaatacaatgaaatagtactgtaaaaatattctcagtaaatgagttttgctgtgaaattggtttaagattcataaaagggatttcaggtttttaagtactcaagtcagcccatgacccagccttcagtggtgtcatcctatgcagtgttagaatgagcctttactccttcaacaaatatttcttaagaactgtatagcttactggttaagaacatgggttctggaggcacactcagtttatttccatttttgtgacatactagctgtgtgaccttatgcaattatttttttatctcagaaagctgttgtgaagatgaaatgagttagtccatgggaagtcttccacagcggctcacacaatttattttttaaaaaggttaggtacagttacattgtcgttattgttgattttcatttcttttgttactgctactatttcttctctgtgccaggcgcacgtctaggtgttgatgagtcagtgatcagagaaggtctactttcatggaccatatttttaagtagggaaaggtaggcaataaacagattgaaataagaaataagaaaaatagacaaaagagataatgtcagatagtgattaagttctcagatgaaataaaataggtcagagtaacagtgatggggatggatattttagattggatagttggggaaagcctctatgaggaagtggcatttgagctgcgactgaatggcttggtgggaaagaaacagtctaggcagagagaacaagtgcaaaggccctgagttgtctgtgaccttggtatgttgaaggaacagaaagaaggttgatgtagccaggcatagtactttaaagggagaatggcatgagcttacattgcagggatgggtagcggacaaatcatgtagagccttgtaaatcatgggaaagactttggattttcttccaagtgttgtagaaagttattagagggttttcagaaaggaatttacatttgaaatatcaacagataccattttttaaaaaattcaagtagagatgatatgtagacagttgattatgaaagtgtgtgtctcaggggagagattgggataggagagatataaatttgggcgtcatcaatatagatgatatttaaagctatgtgaattgctgaaatcaactagacagagaatgtagatagagggctcaggaccaagccctctactctaacattttatagaagtcgccagaggaatccaggcatggtggctcacgcctgtaatcccagcacgttgggtggcccaggcgggtggatcacctgaggtcaggagttcaagaccagcctggccaacatggtgaaaccccatctctactaaaaatacaaaaattagctgggcatggtggcatgcgcctgtaatctcagctacttgggaggctgaggcgggagaatcgcttgaacccgggaggcggaggttgcagtgagctgagatcatgccactacactccagcctgggtgacagagtgagactctgtctcaaaaaaacaaaacaaaagaaagcaaagcaaaaaaaaaaaagaaagaaagaaattattaccagaggagaggaagtgagaaagaaaacttttcatttctgtgtcacagaaattaagagaagtagctaaatgtgtcatatgctgctgagacctaaaaagaaaaataaaggagttaatattggattttgccacatgaaggtcactattattgtaaacaatacactgctatatgaaaagaactagatatcatgccatggactattacagtgtctacattctaaccctaaatggatgactgccttttatctagctcccacaactctaaaatttgaatggtaatattgctctgcctttttgaaaaggttgttataaagaatatgggatataatggaaggaaaggtatataataagtgataaagtcttatacacatgcaaatcgatggtggtagaattatttgtactattagattataaacttcttcagggtagagattaaggctttaatgatcattctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgggtctattgacacaaaaatgggcttgaggactaaaagatttaatgtggcttgtcagcatgaaagaggctgttgtgttgttaatgtgaatgctaatacttacgtagcataaaaaaagaacataggaagtgggcatctcacttttaaaatcatggtgtattccataagtgtcagctgcaaagtaactttccagaaatggtctgatttccccattgacttccattatagaactagagctgtgttcccatggaaaataaatttggccccaggttataataaaacacagtgaagaattcagaaaatcttataaagtcaagtttttcaaggcacaattatcagtacttgataaaataataacaccacaaaatattaatactctatagtagatcttaaaatagtatgccccagactgcaccattatttttctatacaattccaagtctattacttttgcatctagagaaattttacttctgtgatcattattaatttttaatggatttaactctaatttaaactgttgattttgtttccttttttctttatggttagtccacttacctttttctaaaacattcttatctatgacaatcaaaagttactagccatagaagaaagaccagaaggaaatgctccaaaatgttcacaatacttgtttctgagtgggaaattttagttgatttaagtttttaatttctaagttgtaaaaaagggccatttatatcttctataatcagaaaaaatgtattataatttctataagtataaatttatatatagtgagatatctttagtaggacacatttatatatttggttcattttatgatttggtaatggtagttgttaagatcatttattccttcaaaatttttttaaaactggtaaaattagtttctggagataatagcttctacttaattttctagaacatactactcaaagtgtgggcctggaccagcaacatcagcatcacttggaaattagttggaaatgataattcttaggcccctgatctggggccccaggaaacagctatttgtgttttaacaagccctttgggcgattaaggttctaaagctacagaaaattctctctagagctacagcaaattttctttacctctctctccttctcctccctctccctctgtgtccctctctccctctccccttcatcctctcttctccctccccccttccctccttctccgtcttcctcctttcttgccaggccacttcctctcctttatagaggaaaagtagtttctcttctcacccattgctgggtttgtagctgagacctctaaaacaaaagacagattaacaagaggaaaacttatggatttatttaatataagttttatgtgacacaggagccctcaaaaatgaagaccaaaagaaatagggaaacttgtatatttttatgattaggtttgatgaagagtggacagtagggaaatataatcaggcaaagggggtatgatctaatggtaatgagctgggggaacttagcaaggcatatttgttcagattcttctctgtgtccatatgtctccagagataaggacattcttttccttcaggtataggaggagcagctctgaaatgagggtcttataacctacttcagaggcagttaagagaatcattttcttgcctgcttcaggagaaaaggattagaagatcagagagaacttcctgcttttgctgatttctcaaatgccaaggtgccatattttggggaagtgtgtcttgaaccccatcaccttcttccttctctgtttcctttcctcatgtgggttatgcatatatgtatacacacacacatatataacactcatatacagaattcactataacctctttttttttttttttttttttgagacagagtctcacactgtcgcccaggctggagtgcagtggcgcaatcttggctcagcacagcctccacctcccgagttcaagcaattttcctgcctcagcttcccgagtagctgggagtacaggcgcgtgtcaccatgcctggctaatttttttgtacttttagtggagacggggtttcactgtgttggccaggctggcctcaaactcctgaccttgtaatctgctcaccttggcctcccaaagtgctgggattacaggcatgagccactgcacctggcctcactataacctctatctctacttatatagagatgtatattaaaaagagagaaaaaaaaatatatatatagttttttctttaagttttttgccactgttttctaccttactcataaaaatatatgaggccgttttctggtatttatgcctatatgctttcatttagcaaacattttctaacaaatgttccgtgtggctacatattgaatagttctgcctaatttaaagatcttcaagtctcactaaccaatataatgactctatcaagttattttgggctaaaatgtgtcttccccaaaattcatatgttgaagtcctaaccaccatgtacctcagaatgtgactatatttgaacatagggactttaaggaagtaattaagttaaaatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttgaggatcacagtaaatattagcattaattgggggtggcaattagggtacaagttatgatgctaaaaggaatcaaaggctttgctatataaatgctatggaaatacacgtcctctgcatctaacaaaggagtagcaggaagagcacagactgattgcaatagtaacagaaagatatgcataatagttgatatcaaacaggtaaaggtgtgtgtgtatatatatatgtgtgtgtatatatatgtgtatatatatgtgtgtatatatatgtgtatttatatatgtgtgtgtatatatatatatatattttttttttttttaattttttttgatatggaatcttgctctgttgcccaggctggagtgcaatggcgtgatctcggctcactgcaacctctgcctcccaggttcaagtgattctcctgcctcagcctcccgagtagctgggattacaggcacatgccaccacgcccagctaatttttgtatttttagtagagatggggtttcaccatgttggccaggctggtctcgaactcctgacctcaagtgatccacctacctcagcctaccaaagtgttgggattacaggcgtgaggacctctagcaataatccccaacaggaagatcagttaacaaacaaattcattccagtgtgaggtattcccaaagcagtactttctttgtattcccaaagcagtactttctttgtcaatgctgttgccctgtgaaatcatttgattttggtgtgacttcatctgtgagatatgaatatgcttgtggaaatcaaattgctttcatctcctaacccagggcctataacccagagcatacccgaacagttaaacaagcagctttagtcacagaagttaatccacaaacttccagaagtatgatcatatgtcttcttttttgctgaaaatattagttgatttttgtctttgacccttcatagagacacatactttttagctaacccataactagtagaatgtgttctactggcaatgagaagagggctaagagaagtagtcaaatcattttcaaaacttaaaagctgattatatgctatgaacacataagcgcacaggttatatctacttggattattttcaaaaaggacaaaacaatgaacattaaaaaggaatgatgaccagaaaatatactttagttgacacactgaaatgataaatccaataattttttttgtaacaatgtctgtgggtgaatggatatataagaatatgtatgtggctaggcgcggtggctcacacctgtaatcccagcactttgggaggccgaggcgggtggatcacctgaggtcaggagtttgagaccagcctggccaacatggtgaaaccctgtctctactaataatacaaaaattagccggtcgtggtggcgggtgcctgtaatcccagctacttgggaggctgaggcaggagaatcgcttgaatctgggaggcgaaggttgcagtgagccgctggagacagtgagactctctgtcccaaaataaataaataaataaaagaatatatatgtaaaatatataagaatacatatgattaatattgttgatctccatttagatcctaaaacactgtctgtcttattatatgttcccttacctccccaatacacagacacagagtagtagatggtgtacttgcccccccatgttgcagcattcttctaataattccagtgttacagcctgtgtgtactcatattagccatatgcctagaaggctaagaactctacttgtatcacttttcaatcataacttgttttttaaaaatgtaagaatattattgttaacgagacctgattttgtatcctggtactgccactaaaaagctgtgtgactttgagtaagtcatttgtcctttctagctatccatttctgtctgtcttttgtaaaatgaaagagttaaaggattgatctctaagaattcttttccctgttagtagtctgagtcacagttcgaatttcagagatggcagagtcatatatattacatacatatgtaggatatgttttatgtctttctgctgacttcactgcacatgtagcttgagtacagagtaagaatttttcatatattgtcactgaatgtaaataatttgatattcttatgtccagtttcatgtccatttaagttaatttcttgagaacctgttacgattaactttcaaaacaagtaatcagatcctaaatgtgtcaaccaatctgaaacacttacctaatgcactcctgaccagccattgctatctttgccttatataacagtactgctaccacttctatctacaaatctttatcaacttgctgccatgagaattaggtgtgcaacgtattaactgttttgaacgtgggtgggacatataacctctctgggcatttgtttccttgtctataaaagacggaaaataatttaagccatgtcttcctcactactatctgaaaagaccttgaaacctatgctatacagatgtagaatattattagccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcgcggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggcatggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattcttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccctgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcattgcccttaccagcaatattacctagtggcgtgaggttaatttaaggaccaccatgaccactaagtgctatgttttcatacttttccacacctcatcagtgctcctttttttgtttgtgttgctcggtttccattcatttttgatgttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgaagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctatcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacgcctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgaatcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccatcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggagtgcagtggcgtgatctcggctcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatggggtttctgtgagtttggtactcaagggaatatagtgttgtcaactgtgaaacaccaagaatatattcacaaactgcataattttatagtactgattccaagtaatctaaattgggatttcctttggtttgtagctggagtgcctccatgaacacatagggttaaaaatatcactcgatttagctgtggcagtcattccaagtggcagcagccaaagcaaatgtccagaggtaaaacgaaactcgaatgcagacagtggcagtggttgggaagcaccttggtcatcagtagaagagctggaagtgagggagtggggacagaaggcacagagtttacaagtctgccaaaaaactctgtctgcctctttctggaagaagcagaaccggggacttttacagatttcctccttgcctcagcccttcctagctagatcatcttttcctgctagtcccgttatttttactttcttaggcacctgatttgtttcctttccaagatcccattgacttggtattgttatactttccctgttcaacattgacattcttgatcttttccaacaacctccacttcagcatgatgagataaaagcagaaaaggctaattataaagaaggctatcttcccccaagtaaagtaaaataaaaggaaaatccaaaaaacactaaaatcagagtcaaccacaatcagcggagatgtacttactgctctgcttgccattttcattaccatcgcttatagatgggtattactgttatgtaaaatacagagctctaccattgtgtttctaattgtaatctttttatttattttttatttattattatttttttgagacggactcttgccctgttgcccaggctggagtacagtggtgcgatctcggcccactgcaacctccacctcctgggttcaagagattctcgtgcctcagcctctccagtatctgggattacagggacataccaccatgcccagctaattgttgtatttttattttatttttatttttatttttatattttgagatagagtcttgctctgttgcccaggctgcagtacagtggcatgatcttggctcactgcagcctctacctcccaggttcaagtgattctgctgactcagcctcccgagtatctgggactacaggtgcccgccaccacgtccagctagtttttgtatttttagtagagatggtatttcgccaggttggccaggctggcctcaaactcctgacctcaggtgatccgcccacctcggcctcccaaagtgctgggattacaggcgtgagccaccatgcccggccaaattgttgtatttttagtagagactgtgttttgccctattgcccaggctggtctcgaactcctgacctcaggtgatctacccacttgggcctcccaaattgctgggagtagaggtgtgagccactgtgcccggccatctaattgtaatgttttaaattttatatgtaaacaagatgaggtgatagtctgtattcttcattagaaaatcaaaatgttaataaatgatatgattagttgcctaaattataaatcgcccactctgagcctgtgccccctacccaagacctaccatatttagtaactcagaaggagcttccacatattgcctccagcccattcagcggatgtgctgtttcagttaagtaccaaaaggcatttcaaggtagactatcatatcagtagtgataattgaaaatatttttttttaataaaaaacaaaaaggctgggcgtggtggctcatccctataatcccagcactttgggaggctgaggtgagaggatcatttgagctcaggagtttgaggacagcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagcatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgatccgcccgccttggcctcccaaagtgctgggactacaggtgtgagctaccgcacccagccgtaaggttactaaactattaagatcaagaaaaggagtggtgatagtagaagaaggtaaattcagttttggataagttaaactgaaagtgatagcagaacactgaggtcaagatgtccagaagatttttggaaatatagttacagatttcatgacaaaatgaattcttgagtgttctggatatagtgtggataggggaagggattgttatagggatttttaagagaaaagaaaaccaaagacagagacttggaaacaccttcactaaggggctaaaagaagatagacaaggagcaattgggcaggtaggagaatccagacattattgtcctagaaacaaaggaagagggaagtcctaagaagggaggagaggtgaacatttttgacaatgacatacgctctggtggaataaaaaagggtaaaaaaccgatgatttgctatttgggagctttctaatgactttttgaagagcatcctttcaatattgtgatggaactgggaagagaatacagagctatgcagagtagatggtgaggctatagggaaagatcatattcattcaacagttgagcagtcttattgaatgcctcctcggtgcattatactgagttaggtactgaggatacaaaatcaaacgggagcctagaggagctcacatactgtttgggaaaacacgaatataaaccatgtgatcaatttacaatgcggtcttctatatgctgtaatagagataggaacagtaagcctgtgcagcataggagttagagtaaccactcccaaccccccacctctctcctttgtgtctgtataatatgggctattctttctagcagtttggtgggtgaaaggtacatctcatttttccttcacaacctagtatggatttatcttctctgaattttgctaaatctttcttgatcctgtgttgttacagcctttgttaccacataagataataagttgcatacatttaccatctactttgtaaagaattgccctggctgtgtaattgtaagatcaaagataagctttggaggaaaaagaagcacatagagagacaccttgcaggagtgaaaatgactctttttttttttctttttttccttttttttttttttgagatggactctcactctgttgcccaggctggagtgcggtggcgcgatcttggctcactgcaagctccgcctctcgggttcatgccattctcttgcctcagcctcccaagtagctgggactacagggcctgccaccacgcccggctaatttttgtatttttagtagaggcggggtttcaccgtgttagccaggatggtctcaatctcctgacctcgtgatccaccctccttggcctccaaaagtgctgggattacaggcgtgagccaccgtgcccagccagaaaaccactcttaaaatacaaatacacaactccacatctgttttattgccaaatagctatagatacttagagcttgcttctctttcttcaaccaacccgacttttttattctttgcccactgtaagtaaatataaatgggcttctcagcaataggtggatatctaacttagcattttggctatgactggattttgatatatagttctagacattaaaaaaacacacaagagaagcattatgaagaaatgaaaccaggaaacaataaatgtattttggttttagaaccacacggggcaaccaagaaaactaaatttcaaaaatcaggagcaactcaggagacacatgatcctagttttatgtgtcagcaagataacagtataaatgagaaggtataatttaccatttgagaacagataggggacaagaaacaatgttatacaacagagaaaaagaaacctccgtatgtattagggaagaataatttcacagcaaaacaaaacccacatttccccaggcctcactgcctcatgtaaataagaaaactcaaattttgctggctcttgtctctacatacacattcagcacctcatctgctataagggatctatgaagcatttctgggagttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccaggcagcagtgctagggccttggagtacaaatatgggtcttgcccttaaaaactcagagcctcatgggaaagacatatgatataaatttcataatataagtgttcaaaaagtgctaaaaagagcaactaaccgcctggagaattcaagagaggcttcatgatgaaagtggcctttgatctatgtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacacacacgtaaatgagtttgaggctggagacagattttggggacatctgcacatatatatgtttattgaaaccttgggatcacccagaaaggacatctcaaatgagagggttgaggatggtacatttgggaattataatatttaagaggtaaatagagaaatcaacaaaggatactcagaaagaaaaaaaaattagggaagaagagaagcagtaaaaagtggtacctaagagctgggcatggaggcacgtgcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacagggtagaagagggtaggatggaaaaggtgccaaaaatgaataggagttgggcacagtggctcacacctttaatcccagcactttgtagagccaaggcaggaggatctcttgagcccaggagttcaagaccaccctaggcaacacagggcgaccttgtctctacaaaaatttttatttgaaaattagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatgggccaggcgcagttgctcatgcctgtaatcccagcactttgggaggccaaggcaggcagatcacctgaggtcaggagttcgagaccagcctggccaacatggtgaaaccccgtctctactaaaaatacaaaaattagctgagtgtggtggcagacacctgtaatcccagccactcgggaggctgaagcaggagaatcgcttgaacccgggaggtggaggttgcagtgagccgagattgcaccattgcactccagcctgggggacaagagtaagacttcgtctcacaaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggatcacgaggtcaggagatcgagaccatcctggcctatatggtgaaaccctgtctctactaaaaatacaaaaattagccgggcgtggtggcacatgcctgtaatcccagctactggaggctgaggcaggagaatggcttgaaccaggaagtcagaggttgcagtgagccgagatcgtgccactgcactccagcctggcgacagagcgagactccgtctcaaaaaaataaataaataaaataaaataaaatttacttttgggacagacatcacatgtattggctaataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaagatactcaacaggttgtcataagtaccttaaaatttctagaaaattaagtgcttttacaactaaaggaaaataaacatttattctaattggtggccttgattatgggaaagtttctctcatacaggctcatttctatattattaagtattttcctaaatagggataagaaattttaagctctgcttgctttacagcagaatccatctgctttcccagtggacatcccaagacaaccagatttacctggacatgaatgtacttctgacccttcaattttcattaaacctttagatacacctcttctgtgtattaaaatttgaaccttactcctggtagttccttttcttgttgcccattaaaatgagaggagtggaagctgaaagaaggaaggaagaaagcagtaggtatcttaagcgccacagttgttttgttttgggttttgttgttgttgtgattgtttgttttgaggtagggtcaccctctgtcacccaggctggagcacaatggcatgatcatggctctttgcagccttgactctcatgggctcaagggattctcccccacagcccctcaaccccacccccagcctcccgagtagctggaactataggctcacagcactgtgcctggctaattttaaatttttttgtagacagagtctcactatgttgcccatgctggtctcgaactcctgggcttaagcagttcctttgcctcggcctctcagagtgctaagattacaagcgtgatccactgcactcagcccacagaacccttttgagatttcagttcttctattatttcttggtatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtggatttaattctattgtcatatcatcaaccataaacaatcatgaattgaaaagaaaaaggactttaaaaagtacttttctagtacatagattttactttatggtccaaatttaaacaaactcttttgcacctggaagaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttgttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctagagatggtgggtggtgcgttagctctgtatgtaacagggaaaatcctccacaggctgtaaaatgttgaaagcacggttaaaataaaaacaaaccaccgttacattttttacggtagtttgggttataggactacaatgtggccaaatgaaaaggttttttaatttgacttgcgtgtggggcagagaatggcagggctttgttgaggctccctcccttgtttatttcttcccctccaaagcatgcctgttagatggttcttctttcttatcccatttcacttgtcattttatttgttttcaatttaaatatcacgctatttaagaaatagtcactgcttttgaagtttattttacagagctgtaagttttattgagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaagattgttgggaaggggtggaggaaggtagtattttcaattggttacccggcttttaacaaaacaattcctattataatcccagggaatttcatctgactaaatctccactcagacgacaagcaaggagtgagagctgcagccaaagggacaaagagtggggggaaccagtggctgaatgagtcccaccatggtgccctttagtgggtcccattgtgccgtgggttagcacttctcaccattgcttatgaaaatactcagcattgaataatgctgtatgtcttacattctactcactaaaattgcttatgcaatttcaattggctatggtatttatcatttactgtcctctgcattatatagcatggttaagcctaagaagcagctgccttttttttttttaagtggatcaagcgattgttatgtattgtgtgaatatcagttcaagtttcttgagtgctgtagcatctagatgaagggtagtaaataaacattaggctcttaaaataaaaagacttttatgcgattcttcaaattctacattgcctggaaataaatagtggctattggtcccttttattttaataaaatttagatatatccaccagctgtgagcacatataaatctgcactttaatgttaatggaagttaggcatgggtatcaagaggtaaaaatcctagaagatattataaaatcatgttatgtagctcagtttttacagtggttcgaatgtaaggggtattctacatgccataaattactatgtatacaatctttaacctacaacatccttgaataaatagctttagaatcataagcttggttagtttcttttaaagtatagggaggcggtgaatgtattttaattataaaagcctcttagaaaatctgacatggtaaaaggagctatattatgtgtacacgtatgtagctcctttggtgtttggtaagagcactagttgccactctagtattttttcccattgtctgctcaggctgttttcggtctgagactttctcatcccgcagcccccacctctgtataacttttgccctgagtccttcaattgcatagactcttttctttctcttttcatttctgaggtgaatctgggagcccttatgtcccacaatttactgaagtgctataattatggcctttatcttttattaacatacctacatgctatgcttttctgtggtagcccagaatattaatgcaattagcacccttcattaagatgtactgtccattttgaatgacagctttaagtcacaggataagcctcctatacaatgggctacttttttttttttttttaaaggaagaagggaagatttgtaatttttaagaagtgaaaacttctagaaaatctttcattgctaatcctcccaaaccacccaaaaaagagcaagttttgacgttgaaacttcaggaaatcttcatactgataggatcttttccacactttaaaaagttaatccttaagttaatcacaatgaagacaccctgcttatttcctacagtggctaagaagataaagtgagatggtgaatgtgaaacttctttgaaacttttaaagtgtatttatttaaaatttgaatagagctttaaagtgtttaaagattattatcaatactatgttaaatcaatgccacttaaacccttcagtatcttcccatttcttctaggagaaatttaaattttttacagtagctcaaaaggctctgtgtgatctgacatgtatgtacattacctgccgcatctccaacagtccaacgctgtgagaaaatgtgatatccattacatttgaaccacaagactgttgttatattagaaagggaagcattgttttggtgcagatatcttctagtattcatctctcaaataagtctttttggtaaaattaagcaggattttgacattagaagacatgatgccgaatttaagttgtatgatgattattttgatgttattatgaaaataagtgcaatgttattggtttcatttatttctattatataattgattaaaataatgaacaattaaaatgtaagcaatgatttatggggtgcttaactcatagcagtaaatatagtatattgaacttacagttgcattgcctgttagacactatcaatatagaataagtctgatattttctaaatggaacaattagaacaaaccttattttaaagtgtgcctttccccatactccatgttccaaataattataagaaaacctactgcttctgttattacacgtttacaaagcaatagaaatattgcctgtaacctggccttcatagttcaactttagacttctttttttatgactacatctatactgtggaaaatgttttattttcctaggtaagctatgctattgtagtaaaatttttgaaaggaaaattattttggatcaaggacaagcaactctagcagttcagttgtttttttatctcattatttttcaatctaggaaaaatatttaaatatataacaccaatattttgcttggatagattgaagcttcagatgttttagttagaaatggactgcaaaaataatatctcttaaaaaaagaaacgaatatagtcaaatatgtgtctaagaaatacaacttgtgcatacatcctatagtatctctataaagatttcatcttgtttttctgattgaagtgttcattactagagacaaatgtatttttaagtcttgtgattagagggggccacagccatcatagctctattagaggcagaaatataacattaatattttagtgtttcatttgctttcatgaaacttatgaacagaagctatcagtgtctagggtttatcttcaaatgacaaatttagcattctgtaaaaagtgatactaggacttcctgctgaggtcatctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattacatatccctcttgtcttccttcttttcttggccaacttctttgaagtgtactgccatcatatatttttctcttttaaaatgttttccattattaaaggtaatgtatgttcattgtagaaaatgtgggaatgtgtaaaatataaagacaaaggaaaatgcatagtctcaacatccagaagcaaccacctttacattttgtttttttcttctatcttgtatttctatgcatattttacattgttcatattatactgtatacaaagttgtatatactacttttccacctaaatttataagcatttttacattaatgaatatcttgataagtctccttttaaatggttgtatattatttgaacgtaagaatgtatgatattcactccatccatcccttaaattagaaattgaatttgtttctttttttttgctaccataaataatgctgttgtaaacatctttctacatatagtacatatactatatgtagaaaatcagtacagcttttccctagaagagattcagaaagtaaatgacatgaggattttttactacttactagatgcaaagcatgattaacttgggtcaagtcagtgcataaaatctgtaatcactgatttgaatatactatatttacattctttgaacaaatattttaatatttattatagccaaagcctgatggtacaaagatggaccttaccccaaaggaatatactgtctagtatgaaaagagaaacacaataaattaaactgttaggttgagccatatgacgttgttgtttgacctatgaaaatatttatttcatgtgattcaatttaaaataatataggatgataaggataatattgaagcaagtacatggtggcttgggaacacagataagtaagtaattagatcttccgaagagagataacacagattattgctgcttattcagcagaaataaatttaaacgagggaacttttatatctgtgtaggtgtgtattagaaagctgctaggtcaggctcatgcatcagatttatggtattctgtaacattgcagcacaggaacacttcacctctctgaaagtccactcttccagcaactgtacctacctggaaatgctatctatctcttcaaaatatggcagtaaacctgaaagtaagcaaaaacaaaaatatccctcaacaggcgaaaggaatgtgatcaagtccttaaaaagcagcatgtagacttttatcaaaagagagtcttccaagtaccttactcaaaatctatttattatgttagacatagttctatcaaattggattttctatttttttcaccgtccagcaaatgggaaacagcatacataccaggattgagaggtagacagatactttaagactcactggaagcactaagacgtgatagttaatatcttgactatagtggaagagatgaaataattatcaaagcagataatatcttaaaaaacaaaaagcagaatacagactgtataattggtctcaactatgtaaaaaaaagaaataggtatatatatacgcagctgctaattaaaaaattggagtgaaatacaccaaaatattaatagtctttgtggctataccatggtatatgagtgatttgtacttccttcacattttttacaatattcttcagtgactctctgctgattatatcattagaataaataaaataataattggctgggtgcggtgactcacgcctgtaatcccagcactttgggaggcctaagcaggcggatcacgaggtcatgagatcgagactatcctggccaacatggtgaaattccatctctactaaaaataaaaaaaattagccgggtgtggtggtgcacgcctgtagtcccaggtactcgggaggctgaggcaggagaatcgcttgaacctgagaggcggaggttgcagtgagccaagattgcaccactgcactccagcctggtgacagagtgagacttcgtctcaaaaaaaaaaaaaaattaaaattaaatttgtaaatgaaaaagatctttgagcatagaacagttttggtctatttagagaagaaacaaatagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacctccttcagaatcatgcttctttccttcttaatgtctttctttaaattgacttctttctacagaaatgctcatgtcctccttgaacttaaaagcaatcctcaggccgggcgcggtggctcacgcctgtaatcccagcactttgggaggccgaggcgggcggatcacgaggtcaggagatcgagaccatctggctaacacggtgaaaccccgtctctactaaaaaatacaaaaaattagccgggcgtggtggcgggcgcctgtagtcccagctactcgcaaggctgaggcaggagagtggcgtgaacctgggaggcggagcttgcagtgagccgagatcgcgccgctgcactccagcctgggcgacagagcaagactccgtctcagaaaaaaaaaaaaaggcaatcttcagtgataaaccaaacaataaataaacagagtatgtccctaagttactatcctatgtctagctggggagaaaagacatggacacaccaaagaagtaagagataagatatgtatataacaatatttgtgtaccatgtatgaatttgcaggcactaatacccattgatgagctctatttggctattgggactgtgcctctcctaattgtgtggcttggttggaattgcttcatctgatgtggaacctcaatagtcagtcaatgatttgttgtctctttacttattcactctttattttgaaattttcaagtatatacaaaatacaataatataaaaaaaactcatgaacccagcttccacaatgatcaattcatgatcaattttgttttctccatactgctactcttggatattttgaaacagctctcagacattatgtttttttcatctgtgaacgtttctgtaagcatccacaaaagatgaagactatttctaacgtaaccaaatactattatcatatcttactaagaaaaaaaatccttaataacaaatatctatttagtgtttacatttccctgattatctgctttggtttttttgttttgttttgtttttttgttttttgtttttgagatggagtcttgctctgtcactcaggctggagtgcagtggcactatctcggctcactgtaacctctgcctcctgggttcaagcaatcctcctgccaaagcctcccgagtagctgggattacaggcacccgccaccatgcctggctaattattgtgtttttagtagagacggggtttcaccatgttggccaggctgttctccaactcctgagctcaagtgatccacccctctcccaaagtgctggaattacaggcgtgagccaccacgcccagccaattatctactctttttggttagtatgaattggaaaccaaacaaagttgattcattattatggttctgttaagtctctttttaacaatggaatcccccttgtgttaattatcaattattcatcaattgctgcataacaagttacctttaaaacgtagaagcttaaaactacaaatgtttattatttcatagtttctgtgggtcaagaatttgggagcagcttagctgagtgatcgtttcagtgtctctcatgagattgcagtcaagatattggaccgggctatggttgtctctgggtctgaggctagaggatctactccaagatcagttcttcactatacgggcctctctatagagcttcttgactgttgctatggtctgaatgttttgtccccccaaaatacatatgttgaaacataatcccaatgtgatagtattaaatggtgaggcctttggaaagtgattacccttataaaagaggctcaagggagcatgtttgctccttcagccatgtgaagacacctagaaggtacctctgtgaaacagggaacgagcccttatcagataccaaatttactggtgccttgatattagacgtcccagcccccagaactgtgagcaataaataccactgggtatgttgttatagtagcccaaatggactaagacaagcatctttacaacatggcatctggcttccccaagagtgagtgatctaagagagaaagcaaagaggaaaccacagtgcattctgtatcctagtcttggaagtgatataacaatacttctgtcatattctgccaatcacacaaaccaacccagaaacaatgtgggagggaattacaccagagtatgaataccaaggggttgggataattggggggattcatcttggaggctgactgctccaccttttcatctatctctcctttttttcttgtaattttcaggggttttttttccattttctttttctttcttttctttcgttctttttttttttttttctcaaaatcttgagctcaagcgattctctcaccttgacctcccaaagtgttaggattacagatgtgagccaccatgcccagcccagtttttattgttgaagcaaccaggtcatttgtctgattgagtttatattttgttcattgcatcccactgtgttatttacctgtttctttgcctgtccccctactccatatattttctgtaaatttatagttagataaaccaagccactctaaagcttgatcagattcaggttttgtctttttgtcaagatgtcctttttttgttggtgttgtgaggttttatattggagcacatgatggctagtttactctttttgttatattagcagccactgatgattctctagctccattagttcaaaagagtactattctattattcctcctttaattagtttgattacttcataaaaaaaatgccccctcatcaactatttgattacatgaaggtacatttcatataatgaagggatgagaagtacttctctctttttgtcagtaagttgttgtctctctagaatcctctaaaggtaacaagtgaggtctgggaaccaacatgggtatgctgaagcagagtctccagggataggtgctggtcatggggatcttgaaaacgcttcctatgtgattctaatttggtcctctattaacttctaccaatctccattcccagagtctgacttaggtatgggagggggccaaggattctgtttttgttttttcttttaatctctagatactcctcttcagctgacaagtttggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtaaccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgata

SEQ ID NO: 5756 - DNA, 914654 bp, human
tcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccacatgttgaatgtatagatttcagctttaactaccaacttgattataatagacaaggagagggtgacatataaataaagccgtttcttatggcatctggccatttggtttggatccagtacaaaactgtggtttaatcagtgattaaaaatttaagtaaaaagttaactgatagtttccacaaatggtttggtacgtctagcaagaatctgccacttttaagaagtatgctttcgagaaaaaaaaaaacacttatctctgttagtagtaacaccttgattatattcttctcttccctttagccatttgtcctgattcatcttttatgttttacttgctttgacaaggtaactagatagttatgagatcgtatcattttcagttcctagctaacttcactgttccggttcctagctaacttcactgttccgtgttgaacatagcttgatacggtagaacaagatttgaatccaagagtttgttaatattaacatgaattttctttttttgctcaaacataacttttgagccttacgtgattttacaagcagatgtgtcagagttaacaaaaacaaatttaggaagacattgtggcacattttaaggcaagcaagttgaccaaacagtaagatttagtaagcttttcaggaaagaattcatctgggattcttagaagtttgctagtaagatacaactttacttagatgaaatttttttattttgagtattatgttaataatctctgaactagtccttaatttgtgtgtgtatatgagtgtaaaggagttgtggtatgggattataaaagagagccatatggtgatagaaattatttgtgtaggtgatcttggggcataggggttcttaaactcctgaaattgtatgaaaatatttgagtgtatatgggtacatttatttttctgggccccatggctttcatcagtttttcaaaggcatccattacctatagaagagtaagaactatggcattacaaaagatagaaagtaaaggaaagaatagttgattccactctaagttactgagtagggaagaaggggaaatggcattgaccacacaggtgattgatattgaaacgaattcttctagtggtaaaaaagaagttaactactcaatgtctacatagattaaaatttccgctacagaggaaaattaattcagtcgctccagtataatggattcataaggtataaggcttgtgtagtttggttgttttcatttagttcctcagaattctggaaaaatggaaatggaacacatattttcttttctttttttttttttgggacgaagtctcgctctgttgccatggctggagtccagtggcgcgatcttggctcactgcaacctctgcctcccgggttcaagtgattctcctgcctcagcctcctgagtagctgggattacaggcacgtgccaccacacccagctaatttttgtatttttagtagagacgggatttcaccatgttggtcagcctggaaagcagattttctatagagaggaactgctttcatttatatcctcaactttttaatgagtattagtgagaaatttttcagagtggcatttcaacactataatgatttctatttaagattacttaaataaaaatttaatggaattcacttcagtttttttcatataagcatcctcataatgacccttttgttttgattcttttaaaataaggcattcctgtcttggactcatcacattttgaataatgcattagtagtagagttttggattttatgtaactattttggttaggcccagattgcaacatgtcatcaaacagcatgaatcttagattaatttgtaatttgatgtcaaccatggaatgcattttgttaaattgagtagaagagaaagctctataaatgttgtgaaggaactacatcttgaatcctacttatttaaggcagtgacttaaccattaagagaggccaatgttgatgcagaacaccgcaccccacaccacacggtagtgtagagtgacctaacagtatttgatgtttttgcatttttgactttgtgttcctgcataatttctgaagcctttggttcttcaaacagtaaagtcaaattagttaatttttctggttattatgtaacttcctatttggttatttgtttacaactggataaattatgtttttatttatttatttattttgagacggagtctcgctctgttgcccaggctggagtgcagtggtgtgatctcggcccactgcaacctctgcctcctgggtgcaagcgattctcctgcctcagcctccctagcagctgggattacaggtgtgcaccaccaggcccagctaatcttttttgtatttttgtagagacggggtttcaccatattggccaggctggtcttgaattcttgacctcaagtgatccacccacctccacctcccaaagtgctaggattacaggcttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattcttgaaaacctggcaggccggtgcttgggtgcaaaactattcagtaaataattattagctggggatttttttcccctatataccaggtattttgagagtgtaaattggtgaaaagaggctttttaaaaaaatgtttatttgtatgtgccttttttttttttaaagtatatgtactccatcaattgaacctatccatacattcctctttgtcttttctccaattttgaaactcagtaaacttcttcagggctgtgagaactcttctacccccagcttgtttgaattcttgtgatgtcagagcctaaacttccaagcatggaaacagtaccaacaacgatgagccaagtaacattttactcttattagcaggagacttcatattattggcaaaagaatatggaacggagagccaaaagacctgggttccagtgtcccatctgtcttttatttgcttgtgatttctgatgagccatttagcaccagaagtttgagctctttgattaatgtttgccagttggggataatgctgcctgcctgatttgcttcacaaggtgttttagataaaatacagtaaggaatgagaaagcattaggaaattctatattgttatacaaatatagagcatttttattaaccccttatattacttgaatcaaatatgattatggttggatggtttaatgtctttcttgcattttgacagcactaatgttattattgtataaagtaccataatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaacttaaacaaattttcaaacgtgctaaaaagtagaatagtacaatgaaccaccaccatctatccattgcccagatataagttatctacattttgcaacatttgcttgatccatcctttatttttcccttgctaaagtattttagtgcaaatctcagatatcttgtcattttactcctacatactgtcacgtctttaaaaattaaaattaacatattccttggtatcatccagcattcattccataatcaaatattaccaattgcctaaaaaaattagatttttgatctaaggtgtacctaattgatatacatgtcactgaactccttaaacaaatacagctttaaattactggtaaaatcttattcagagttactccacataaagtgctatcataaagcctcagcccaaattaagttcacttctgtctttaattctgtagaagtatctggaaaggttgactatacaagggtggatagactccttggaacagctgttatgtaccatcaaaaatagaacaaattagttttggctttactcactggttgggcaatcactaattcttcattttgcaatttgtgaagtggggtggggcttatgtgtaagaattttcctttcagggaaatgctgtagatagttaggcaaaggaaaattattcttcatttctctagataaagcgttcatatgactctttgacattcacaccccaccacaacaactaagtttatgttactggctctagttttatttcaaaacaaatgccggtttggtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttatttgtcattggttctgagaaaagaatgtaagatgtatatttatgtaatatcctacacctgattacttttgcttttgaattattgaaatcttcaaatgtagatggctgtgcccttgagggcctaggttatagttcagtatgttcattatcttccccaacttaagggttgagttctgttatagctaattgtagatcaattagcttaaggctcctccctttctgcactcctttcagcaattttcttgacataattgtttcacagagttttatatggttacgcattatctaggctgcattttttttttttttagatggagtctcactctgtcacccaggctggagtgcagtggcctgatctctgcttactgcaacctccgcctcccgggttcaagcgattcttctgcctcagcctcccgagtacctgggattacaagcatgcaccaccacgcccagctaatttttgtatttttagtagagatggggtttcccaatgtttcccaggctagtctcaaactcctgacctcaagtgatccgccctcctgggcctcccaaagtgctgggattacaggcatgagctaccgcgcctggctgcattgttttttgaagtttgtaccatgcttatttccactttcattgctcacgatacagggcagaacatatagaaagttaagatgggttaaaacaaatttggcagaagcatttcctctgataatatgctctgcaatctagtacctcacattacaaaatcaacgtttttcagaagagtcagtgtgtacataaaatatttgtgagtgaaaataaacttcttagggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccacttcatgtttttcaagatgcctacattgtattttatggaatctaaatgtatttaatatgctatacagagttgaaataagctaaataggatatttgatcctattaagtgttttttaggagtttgtttctggttatttaaaaaggttgggctgggtgcagtggctgatgcctataatcctagcactttgggaggccaaggcaggaggattgcttgagcccaggaggttgaggctgcagtgagctgtgatcgtaccactgcattccagcctgggtgacagagtgagaccctgactctaaaagaaaagaaaaattttaaaaaaagatcctgtagagataagccgactactttttaaaaatgtgactctggacaagtcttttatttttcttctctctgggtgtcagtgtattctgtaaaataagggaatcgaaatagatgatctacaaagttccatttagctctggcatactgggagtcaaagtttattgaaagctgtaatacatctaccctaacataaatacaagacctctggattccagttagacaaaaagttggaattaggctgaatgctaaagagtgaatatcccagttaactttattgtcctgtttctggagtctaggttagcctagtctagtgaaggccacatcaacgtttctttttaactatgaattgtacggaaggtaatggtctgagccctagggaatgctggcttcctctgcgtcatcctgattcttgggaggatgctttggttcagtgaccaagtacagtatgcaagccttcccagagatgattctcaatagtacacaatatcataggtaccagtttttgttctaagtgctttgcgtgtatttgttaagaactgtgcaaggtctgggattttcccttacttacctacctgttaactgtttaatggatgattgcagaagacccaaaggacaaaagacagtttattattcattgcaaaagcagtagccagaatgtcagcatgacatgctggttcactatgaccataagtcccatcgtgggtagaccagcatgatggccacaaacggagtcagtgacattgcaggagaggaactctgagcttgggggtttgctacttttatagcattaagaagtcagcttgatctttggggtggggagatatcacctcatcctcaaggttgtttgctacaaacacagccatgggaaatggccccagtaaaatgctgtcagtgccttttagtcttggcatagccagcaagaatgggcaggggatgctcagggattcatggcagattgcctccttcatcagttttaactaatttcatcctcacagcaatcattttgtaggtgaagaaaacgtctccaagcagatgagtaactggcccgaggacatgcaaaggtgaatttagaattgaagaccaatgtggggccagatgtggtggctcacacctgtaatcccagcactttgggcggccgaggcaggtggatcaccagaggtcaggagttcaagaccagcctggccaacatggtggaaccctgtctctactgaaaatacaaaaattagccaggcatggtggcatgtacctgtaatcccagctacctgggaggccgaggcaggagaattgcttgatcccgggaggcagaggttgcagtgagccgagatccgccactgcacttcagcctgggcaacagagcgagactctgtctcaaaaaaataaaatatttttaaaaataaaatagaattcaagaccaatgtgactgtaaaatgtatgttttacaccacgattttctatactgcctgagaacctcaaggtagctctaaattgaagacctagtggttctctagactggtgatggtgggacctagcctagatttgcactctgcttatgtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaattttttttttttttcagtagagacagcattttgctgtgttgcccaggctggtctggaactcctggcctcaagtgatcctcctgcctcaactcagcctctcacttggattataggaatgagccaccacacctggcttgattaccaatgttaatgagctaatatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagagagggaactaacgtttagtgagcacctacagtatttcaggtgttgttctaggagctttacatcaccatcttaattttttattataaacacgtaggcatagttatttcccacatttaacaaatatgggaaacgagtctcagagaggttaattgattctgattccaaaatacatgatattttatgatagcattctgtcttcttcttacaagtaacaggctatatttaaaatctagaaatgagctgtaattttctattttttacataaatatgttttatttttctcctatcgcagatcctattaggagtctaataaatgtattttaacacatttcctttttgttggattacattagttgagaaataatagagcttgagaaattggctgggaattgtccacaaacatctaatttgtagctgtatctggttagttttattactgatgatttgggcaagctcctcagttggtaatattctacctctgaaattcttcatgttcaatagttaatctaatttaataaatgttttggagaagctcacctcagtgctgcggtaagcattatcagggttaaagtaaagaactcctacccactagaaacatagagttggagaatctgatgtatacaaacctgtggtgctgggtggaatgtgataagtgctactgtagaaggaaaaagtgctatgggagcacaaatcgtgttaattccaaatgaagtattagggatgacttcatggaaagataggcaatagaagagagtcttaaagtgcagagattttttttaaaacagttattgtgatagaatggagaaagggcattgtctgtagtgagaaaaatatgcatatctcagtcagcacaggctgctatagcaaattcccatagactaggtggcatatgaacaacagaaatttattacacacagttgtggagactggaagtccaagatcagggtaccagcttgatagagttctggtaagggccctcttccgagttgcaaactgctgacttcttgtggtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatgaaaggcccttgggcaggggctcccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagcttgcaaaaaatatagatacaggagtcccaatggacctattgaaacagaatcctttgagtgcaggccctgggaatctgcattaataagctgcctgcatgattttgtactctaaagttggagaaccactaaacttgtgcacagtttgcaaaatggcagccctgcaagtcatacctggcccatagatttgtttggtttggctttcagtattagcaatgtggtttttaaaatttgatttgtttgctaactcttaagaattgggagtttgtacacataaatctaaattcctggcttctcttgaaacatcagagtaatttttacagtactaggctcatgttctcacatggctggcagcaatccactgtgtctgaataagatctgtcttatttgaataggccatgtgctcttgaattggccacagaccaccctcctgcatttcacctggggtccagtgttaattgacatttatttttctatagctggcctgcatcactcaattatatcccctgcttagaatccatatacatttgagtttttgactctggatctagaggttaagaactacacagaaactatgggaaagaagtgagactggaagctgggagaccagagagattataatagtggagataagaaatgaaccatggaactacggcagtggtactagggatggagaagaggaggaagattaggatttagaagctactaattgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggcatatgcctgtaatcccagctactctggaggttgaggcaggagaatcacttgaacctgggaggtggaggttgcagtgagccaagatcacgccattgcactccagcctgggagacagagtgagactctgtctcaaaaaaataaataagtaaaagaatacatatgtactcgtctcaaaagaaaaaaaaatgcttggcacattgctgtagggtatcaccaagacacaatgatttaatgacaaccacttctttcttgcaagtggtaattttggtttctttctccctttatctcttctgcattttaaattttgctctgtgagtattctttagttctgcggatgctaggagcatgctgtattctaaaaagtgtttgcaaggcatttttctttttttatatctccaagaaaatgtttctttgggaacatgttatgaatggaggttaggttcccagggtagctcatctttttcaaatcccacttaatctacattgcagatgagctgttctattaatagcatgtgtctgagctctgggagcagacatgtgccatgtggtatagaaacattgaagaaagtctcttcctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatattttatttttatttcagtagttttgggggaacggggggtttttggttacatggataagttctttagtggtgatttctgagattttggtgcacttgtcacctgagcagtttacactgtacccaatgtgtagtcttttatccctcaccctccctcctgaaaattcattgcatcattctcatacctttgcatcctcatagcttagcacccacttatgagtgagaataaatgatgtttggttttacattgctgagttacttcacttagaataattgtctccaacactccactcaggttgctgcaaatgccattatttcattcctttttatggctgagtagtattccatgttgtatacataacacatttgctttatccacttgctggctgatgggcatttaggctggtttcatatttttgcagttgctaattgttctgctataaacatgcatgtgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctgaaaatgaagagaccttttaacctggtgggtcaagtttgacttaagttcttgaacaaattcactgtaagtactctagaggcagtgtttatgagggaatttagatgccaggataatttttttaaatagaaggaataaattgccccttgtttcccaattaagacacctaagaagcttgatctgtaatcatgtcttctgtggttactctctgaagtcttatgttgaaataagtggctgtctctcttctgtccctttatgtaccatcactggtatagccagtcctgcctatagaaaggaaaaatcaagttttttacacctcgtgttagaatgggtattttctacagaaactgtttcaaaggagaatggagttggaatactacttactaccagtgtgactctgaaggtgtattatagatttttataggattttaataaggttttttaaagctgatttgcgaattcaaccatcattgagaactttgtttctgtaagaaaatgtagtcgcagaactaactccatatgtttcatcagggctacgaagggcccatgtatgtagaaaacttcagtagtattgattatggctactaaataggtaattttgttgaaaataagtttaacattattagcaaatagaatggtaattgaagagaagttaatttaggaattttgtaaaaaacttggctatgattatggtactgacacagtaatgtggggccagaacttatggtaaccccataagagtgattctataatttttttttttttttttttttttttgagactgagtctcattctgttgcccgggctggagtgcagtggtgcgatctcggctcactgcaaccactgcctcctgggtttaagtgattctcctgcctcggcctcccaagtagcttggattacaggcgcccaccaccacgcatggctaatttttttgtatttttagcagagacggggtttcactatgttggtcaggctggtcttgaactcctgacctcaagtgatccgcccgcctccgccttccaaagtgtcgggattacaggcgtgagccaccacgcttggctaattctataaatttttaagcgtatctttatttgtttttcagtgatctactgactgtaaatcattctgtcagcttcatagtaacatttaatttcaacctacccagtccctaattggccaaactgttataaaaccaaattacgcagcagtgaggaaaatagaaacttgaatgaatgctattaaaataagtttagaccatctcaaatttatcctcataattcagactttctctgttttcaaagaagacgtctcatacacactgagtgttattggcagatttgacatggctggagtcttatgtgcagaaatataatatgtatctgtcagtggttttcaggagcccctatgaaagggcttgattttgctggtttgaagcctttgttggcatcagcaaagtcaaagagttgtaggcaaggttaacagccacttcatatttaatgggtttatgcaaaccgtgatctatatattgattatataaaatacatcactgttgtcttaacatccagatgaaaaggaaaaaaatgttttctacatcaaaatctttagacttaaaaatctctgtgattcataatattaattaaaagagaaaataaaaatctgaataatttgctttgacctgtgtatgtataagggtcattataagggttagtgcttgggttgcttgtgagttttcaggcaaagggacatacagctcatcttttttatattgcaactgatcagtgattaatacttaagaggcttcaggggctaagtatagttgctgatttatttgcagctcttactccacttcaattatttaaatacagcgaagagtccgtcgtgagaaacacaacagagtaggagaaatttgagatctatcagcataaacagatacaagtgttgctttgccccaaatcataaaaagtaaaaaaattaaaactacctgttaattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatcctgcttagtgtgttttgtaagatatgatacacctagcatattcctttctaaaacatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagcactacttggctaaatcattgatctaagagtatctgttatgtacaaagtactgtgttggttttgaaatttttgtatttgtctaaatctagctttttcatttctattgctttttattcatagtctaagaaagaagaactttcatgtctacacaacttttttttcccatttgaaatgctttaatattgtgaaccccataaatttgagacaggtctcagtttagaaagtttattttgccaaggttgacaatgcgcttgtgacacagcctcaggaagtcctgatgacatgtgcccaaggtggtcagtgcacagcttgcttttatacatgttagggagacatgagacatcaatcaatatgtaagaagtacattagttccatccagaaatgtggagacaactcaaagtaaggcctccctactgggggcttccaggtcacaggtaggtgagagtcagatggttacattcttttgagtttctggtaagtcttttcaaaagaggcaatcagaatatgcatttgtctctgtgagcagagggatgactttgaatagaataagaggcggttcccagcttgaagaggcccaagatattttcctttcacagtataaagcaaacaaacattctttctatacctgtagaggatgctactactctaaaagctggattattcctgcaattgtttctgcttaattcaggcactaagtgacttcctccaattcattagtgtgaacattcttaaagacctaagtggcagacatatttcctgaaccatttacccttagtcctgaagctgatcaggtttgtcacacacagactgctatagtcacccctcctggcagttcaagattgagctttatggcaagacaattcatttaagattgagcataacttgttatgacagatttatcaaaattatccagtgaagtaacatagacttctgctttgtgaagaaaactgaaaccctatactgtgatgtcatatttgttctcttatagataaatattttgttctttataaattgaaagagcatcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgtttaccactgtattcccagtgcccagtactgaacagtttcacttatgtcactcgtgtccatgtgaagagaccaccaaacaggctttgtgtgagcaacaaggctgtttatttcacctgggcgcaggcgggctgagtccgaaaagagagtcagtgaagggaggtaggggtggggccgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgactctaataaagatttttgggggggtcatttttgtttctgactttttttaactccatagtagctctgtagtttgtacacaggaatgaaatccatgtttacttgcatgtggtgtgagacagatgcacccatccacataaatgaattttgagagcttgtcccagaagaccatcattataaatgaaaaaaatttttttggtgtttctgttgttattctcaagtccttttatacctttcttttttgactaatatagaaagataattgtgtagcagaaatgatttcgttttgtttgcagatcatttaattgtaacttatacaatgatttcaatgcatgtttaatgtacagtggctaaaaattaccccttctgaaattcagcccttcatatctgcttaaagattttccttttcgatagaccatatttgttcttttttctgaacagttataacgaagagctttaaatagtattatatttatgaaagcagatttttacatgagggaaatctgagaaaatattcgtattaaatgtatgtggttatacaggatatccactctagttgaatgaaatttacaaatcaagaaatcaggagtggggtgtttttctttatgtttctctatcacacgtaattaggataattttttacataagtataatttcctatgtgccttcgggtactctatcattcttgtagatgcctgtcaggaaaaaagaaaattctttaagaataaaacaaagcacagtccttctccagtattatttttgaccaggggtccacatttggtttatcaacaactaaactttcaattcaagggcagctctagaattagaaatgtatatagcagaatggacattccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgttttatagcttgtggcctaaatcactgcctatattagataatgaataccatattttgagtattcagaagtttatggcaggagaggggagagatgaggaattaaaccgtattacattgttaatttgaccagagaagaactagagatcttgatttgtgattcattcattcaaaattatatcccacatgttactgtacattttttgtggttgtctatttacctgtagttgtccacaggagtttcaaaggtcgccttacaccaaaataaaaggttaaggatcagtgaaatctagaccctactgtgcccactgtggaacatcttgtcatcacctctcctgctaccctcatgtttatttctctcctgcacctagaagagttagtaggccttgaataaatatttgttggtagctgttgaatgaatccaaacaaaatttccctttaaaattttccttgactattccttccatctagccacaactggcattttgggtattcccctgaaacgagtcctgacacttttaccctttttcactcttcttcctgcttctgtggtgcaccctttttcctgctgctcctttcgtgctatcttctttaaaccatctttcaacaaccttttctcttttgaagtctgttattgctgaccttccttgatgatagcacctggctatgcttttgtcctttacccttgctactcattttggtgatttcaactattacgctaatagccttcaatacattttttgctcttagttccttgtttgctaaactctgacttttgcatttatatatttagctaattataggtatgactgtaccttggactgtgtcatcctttagaataattccacctctaagagctttaactctaaaattttccttagaagctaaacaatttacactacctttccaagacccttaattttatagagcatgtattgtgtagtggttaaaaacctggactttggggtcattcagaatgtttgtagtgtttctttcctttatcaaataagctctgttgtgtctttaattgctagtattttctgattacctagatacccctcagtttatcaccctggtgtccttaatcactgaaaacaatgatgacagcaacaaacacagaaacattccttgatactattaacactttttatctttttaaatctttcttctctttaaataaaaattatactcattgctttaagctgctgacaatttggttactaccttttgcagtattgaaatagttctccgagttcatcagtggcattgctgtattcagtttttctacactgagcattacagggctatcttcccttcattgattatctcattcacttctaatttcttgccaaatcccattggttttgcttttgtaataactgttacatttgtgtcctcagatgtcctccagctgttcttgccctactttagatgataaccctctctagttgtttctcatggctattaaaatagcctcccaactggtcttcctcccatcctccaggttttgcctattccaatccagtattgccctatgatttggacacagagttcttttctgaagccccaggtgggcctttatgttttcagagaatcagtttatatgtccctactccgttccctcaactatgcccctagatgcctttcacacctttgcttttctgctccaacctcagagctcttccccatctttattctctgctgatgaccttgctgcttaatttacgagtaaattgaagcattcagaagagaacttccacaggctccccccaccacatttaccttttagtatctgcattcatgtatctgtcttgctacctatcaccatagatgaaattttcatgtccgcattcttctgcttgtgtataaattttcattcctttcagctactcacagatattgcttcaataattttttcttctctctcctaccattctgagcagcatgtaaacatgcggtcccatttttcaaaagccttcttttgaccctttctctgttgctagctatcactccatttatttactctccttggaagcaaagcacctcacaatataattttattcatatgcactgcttccagttttaatcctctcactttctcttctaaactcactccaaccaggtttccatcccaccattctatcaaaactgctcttatcaatgtcaccagatatcttcatgctgccaaatcccatggtcaattctcagttctcatcttaatttttttttttttttttttgagacaggatctcactctttcacccaggctggagtgcagtggcataattatggcttactgcagcctcaatctcctgggctcaggtgatcctcccaccttaacctcccaagtaactgggaccacaggcatgcagtgcaccaccatacccagctaatcattttgtattttttggtagagaccaggtcttgctacattgtccaggctggtcttggactcctgagctcatgtgatctgcctgccttggcctcccaaagtgctgggattacaggcatgagccaccatgcccagtctctcatcttaattgacctatcagtagcattctgtgcagttgattattctctccaatttgaaacactttttatttttttgtctcctcaacattcatcttgttttcctcctacctctcaggccactccttttcagtcttctttgctcattcctctttatgtcctgaacctctaaatcaaatttacattcaacttagtcctcacatttgaactccagactcatatattaaacttcataaccaacatctttccttggatgcacaatagatctctcaaaataacacaaccaaaactgaactgctaatattcccctccagacctgctcctacaaaagtcttccctttctcagttgacggtatctccatccgtccacctaggccaaaaactttggatttgtccttcactacccttttctcacattctacagtcaaaccattagaaaatctcattagcttttccttcaaagtaaggcactttcaacagctgaccatttcttacccacctccactgataccacactagttgaagtctcagctggaccactataataatggtaggattattaggattaccacaacccctaattgatcttcctgctttcactcatgaccctctattcttagcacagaaagattattcatttaaaatatgaacatcatgtcacttggctcctcaaatctccaccatggttctcatgtcactcagtgaataaaagccgatgtacttgcagtagcttataagatcctatatgttttgacacccaccacaccttacctttttgatatcttcctctactattctctttccgctagctcacagcttcagttgcactcatgccttttattttattgtagctctaaggaacaatgattcctgttagtttttctttcttttttttttttttgagatggagtctcactctgtcatccaggctggagtgcagtggcgtgatcttggctcactgcaacctctgcctcccaggttcaaacgattctcgtgcctcagcttcccaagtagctgggattacaggtgcatgccaccatgcctgacttatttttgtatttttagtagagacggggtttcaccgtggccaagctggtctcgaactcctgacctctggtgatccgcctgccttggcctcccaaagcgttgggattacaggcatgagccactgtgcccagccgattcctgttagtttttaatttttaaatttatgtacaacatttacagtgtttttaaacttcgtacatttctattttgtggtttgaatatcataatgtttcatcagaaaattactatttcctctttatgattttttttaaaaaaggatttgcttgttggattcataaatgtgatttaaagaactgtacaactttgtgccacattttctcaaatgggaattttttcttccatgggaattttgaaataggatattaagaaaatatgtttttcaggtactatcatattgtgttataattttatttgatggatctcttttatgttatgtgacccacataatcattatagacttgtatatgcagatattaaaatcctgtttatatctagtagtggaattgctggatcatatggtagttctgtttttaatttttaaaggaaccttcatactatttatcatagtagctgtactaatttacatttttaccaacagtgtatacaagtccccttttctccacatcctggtcaacagttgttatcttttgtcttcagtaatagccattctaaaagatgtgaagtcatatctcattggtgtcttaatttgcattatgttaagtgaaataggctaggcatagaaagacaaatagcacatgatctcattcctatgtgaaatctaaaaatgttgatttcatagaagtcgagagtagaatggtggttaccaggggctagggtaattgggcagtggggagaggggtaggttgaggagatagtggtcaaaggatacaaaatttcagttagatagaggaataacttcaagagatctattatacaacatggtgactattgtatttttgaaaaatgctaagagtagatgtaaagtgttctcaccacaaaaatcacaaccatgtgaggtaatgcacatattaattagctagatttagtcatcccacagtgagtatatacttcaaaacattgtgctgtacatgctaaatgcatacaattttatctgtcaattaaaaaaacttatttataaatggacatatattatttttaaataacagtataatataataggatatcagagaaatatggtttgattaaaagtaacaaccaaaagttaaactgaaaactttaaagattatctctctactttgagagaagtctacttataccctgaatattgcgtattttctatattagtttgacggtaataaccttacagtgaacaaattattttatgaataactatagttttcatctactgtatacttatgcctaaggcatgaaactaaaacatttaagtgtattatttcaattgatccttatgacagtgccacaaagtaagtaagattgttataccccattttcagatgaggaaagtgaagcttagagagaggcaagaaaattggttcattaacttgactaagctagtaagtagctgagccgaaacttaaatttaggtacataaaaatctaaaacattgactttttgtaacatctgcctttaataatgcttcatttaaactaaatataaaattagtacattttccttgcacacatagtgaggagaagtagaaggcaaatcagaggtacattagagtggtaggtaaagccagcctgggatggattatttcctactgataatggaacattgtctgtaattgctttttatggagcatcaattgagaagaatgagtccaaaaatctagcaatggaaaactgttaaaaatgtcattatcacagttgattgggagaaagcacttaagtcattctgtttctaaaacacggaagtagacttccagatatgaaatttatctttttttatttcactccttgtgggtgtctttccttgtacaaataacgtaaaaggtgttcttgtcgtatttgatggctcttatgacaatcttccttcttctgggtcttttgatggtagctttattgtgctgtttctcttgattggcttttctgactttagagaactacaaaggtttagaccatttggtttcaatactatatatgtattttaggataacatactttgaggtgtaaaacttttttttttttttttgagatggagttttgctcttgttgcccaggctggagtgcaatggcgcgatcttggttcattgcaacctccacctcctgggttgaagcgattctcctgtctcagcctcccgagtaggtgggattacaggcacgcgccaccatgcctggctaattttggatttttattagagacgggttttctccatgttggtaaggctgatcttgaactcctgacctcaggtgatctgccagcctcagcctcccaaagtgctgggattacaggcatgagccaccgtgcccagccaaaacgttttaaataattgcagcacatagcatgagattatgcacagtaataatatatgagacacttgacaagaaataaattaccttacaatttactatttagaatttctgggtaatgatgtattggtgaaacttttggttaaaaacttaacaaaagataatattcaaatataatcctttcttactctgaaaattgaaactcttgttatacctgaggatcacatctatcaacagcagttctcattggataggcttgtagatgtagataattgagctaaatctaaaattactgcaggatatgttttttctaaaagaaggtagctgtttttacttaattactaatagatcatttcacaaatcacttgattcttcatagctaagaaaaattgtgaaatgagtccagttaactgaaagatctgagtagtctggttttactagtgtattagtagactactaatgtctcattgactctggcatctattctgtgcattggtgcatcacttttcatattgtgcttattcaatgatgcaattttaaagggactttctaagtaatggtatcaatggctattgctggcaagtttaaagttccaaatttgaaataaatatttatttatttttttgtttagagacaggaccttgctctgttgtccaggttgtatcatgggtcacagcagcctcaaactcctcggctcaagccctcctcccacttgagcctcccaagtatctgggactacaggcatgtgccaaataaacgtgatttttttgtttattttttgtggagatgaggttttgccatgttgcccaagctggtctccaactcctaggctcaagacatcctcctgccttggcctccaaagtgctgggattataggtatgagccacggcacctggctttgaaatttcttgatgattgtttattttatagaatataagctctttattaagagagtgtctttcatagtttgtaaaagtgaattttgtatttagagtatggttaccaactactaactgaaaattgagaagtggttcttttactaaagttttcaagaattaaaaccactgcttttataagattgataaaattacctgcatggggtaaatcacacttgctctttaagattcttgtctccctcccatacccagagtcatgttttcaaatcttccacaagtgggtaaaggtagtaggatgaaaacaatactccttccatgttattattattggtaactttttttttcttttgttttttttgtttgtttgttttttcgagatggagtcttgctgtgtccattaggctgtagtgcagtggtgtgatcatggctcactgtggccttgaccttctgggatcacacaatcctcccacctcagcatcctgagtagctgagactgtatgcacgtgccaccatgcctgcctaattgttttgtagagtgtgggtcttgctattttgcccaggctgatcttgaactcctgggctcaagcattcctactgacttggcctcccaaagtgctgggggttacactgtacccagcctatatttagtgacttttaaagatgactgaactaaagcggttcatattcgtaactcttctcatattgatcagaagcattttatattgcctctaattaggattggatgaaatatctcctcaattccactttaaatgtaaggaaattaataatgctgtaattgagtaactcttcaatattttaagttgtcataacctttgagcttgctgagaataactgatctggtttttgtacattgagtatactgcttagggactgttaaatgcttattagtgttttcatctagactgaattatgcaattagagttctttttggggagaggggtgttgggagaggggagattttcattttaagattaaaaaagtaaacccatagaaatttcttgggagttcatgttggaatttgatttctattagcagcacaaggaactcccaagtggaggttcaggttgcattggcaacatatagatacgtcaataaggactgtgttctgatataggtaattaaatagtttgtcttatgcaaaagatgaggctagtaatgatttatgattaacctctagccatatttcatttcaacctaatttgttaaaggtaatgtttaatatatgattatacatgcaaatttgatgttttacactcttttctattcagcaatttatattaatatactttgcatttttgtcataatttaatgataatagttatatgcaataaatactaaattattccatctgctagaactctcataagtaatcccaaaccttttaatttttgttctctcacttttctctttcattaatttagagagaatagttgtgcttgaacaccaggtgttatacattaacccaagcatccttgttctccactgactgctattataggtttctttctcacccaaccctagtcttttagaagttagttagcttggatgaatcttttcatgccctcagaataagtaattttaattaatagtttaaggtagcacaaaataaattattggtaaactaggtcttaaaatctataataagccatggaaatagttgtcagaaatgattagaatctcagaaattgtctagacagcataatatccataggttatatttacattttcaatatccttactccatatcattagacggagataatgccagaagcatttctagacaacatgttttattttcttataaaactcctatgacgagcttataaaagaggagcaaaacttacccagtaaacagatctaaaaggtaactaaatctgggtcaatttttaattttattgccgagcatgattttttaaaaacttggctctgttcttgatttgtacagagaaatgctttcaaaaatatttcttctgttttgaaggattctactagtatttatttgcatgagtgtatttaagcaactatttattcatatgtgcaatgtgccaggtaggatgctacatgttggaagtgtaaagatgaatgcaacacctcccttaccctcagagagctcagtgtttactcagggagaaaagtacataaattatttccatagcactaggatagctgtgaataggctactgtgggaacttagccctgtgtaggggctcaggatggaagcagagaacaccacctaaatacactgtgaaacccagtgttacttctgaattatccgtctttattttttggcataaatgttctcaaaatttgaacagtttagttcatcaaagtcccatgccttccatatgcccaatactgttttaaggtctgagaagagagcagtgaacaacttaaagaaaatccctgccatcaaggagcttatgttctggcaagggtgatatactggaacataaggtggagttataaaagaaaaggaaaagacaaatatctgtgtcatggtgaagtttatttgacaactctctactgaatgccagatactttgttaggtacagcagacataaagatgtcaaaggtactatccctgccacaaggtttttattttgtatatcctgctgactaagaatggttttatatttttaaattgttacccaaaaaaagactgtttcagggcacatgaaagttatatgaatttcagtgtccacaaataaagttttgctgaatgtatccacgcccatttgtttatgtattgtctatagctcctttgtgctacagtagagttgagtagttgagacaaagattatatagtttgcaaaacctaaaatatttactgtctggcaatttacagaaaaagtttgccaacctctggactagtccaagagtctctaaaccttttatttcctaccccatcagaaaaaaaaaaaaaaaaaatatatatatatatatatatatgtttgagtaagtagccctaatatattttaaacattatatacatgcatgtatgtactaatattaatatgtacattacaaaatatacacagtaaaaatgagaaaaacatgaacaagattttaaaatgatttaaaattagtttatttcttaatcatacagaagtctttgctgtcatgattaataactttttagtgagaacagtgtcactatgtcatttttttatgtcttgcttaaaaataggcggtaattagaaagtttagctccaagttcattttattttgatatttggtttaatttctctcataattgaaacataaatctgacaaagatttgtaggtccaaatcgaacaaatgcaccattagcaacttactaaattgtagtattaacttttatcagaccaatccatgaatcaagcaaagatttcctgctgaaccatgactagtaaattcctgtcttacttgatgacagccagttattcttgcaactaatctggggtgttgcatttttatatttctaaataaatgggtttaaattggactttaataaatgggtcttcaacaagtgccattgggaagatgggctctttccattttttcttctacattattaatgtgtagaccctcatcctcatgtttgtgtactcatgcctgttccagacagtacatctaacaccaggaagaaagaggaagtaattcaagcaagggtgaaggggactgacttggaagttgagtctgttgggactgacttggaagctgggtctgtctgtgtggcttttccagtaaagtaggtttgaaaaggagttactttcttactaattgttaaaacgtcaaggaatttcttcactttttgtaaatgaaaaatgcctaactcatgctatatttcaagttttttttttttttttttttttttgagatggaaactcactctgtcacccaggctggagtgcagctgcgcgatctctgctcactgcaccctttgcctcctgggttcaagcgattctcttgcctcagcctcctacgcctggctaatgtttgtatttttagtagagatggggttttgccatgtcggccaggctggtctcgaactcctgacctcaggtgatccgcccgccttggcctcccaaagtgctgggattacaggcatgacactgtgcctggctaatttcgacagttttaaaatactttatcttgaaataaccagaaatatctctggttttcatgttaacttcctatttcatttcaaaatattgtaaatattttattgtatttgaaatatcttgcttttatttaaagaagaacaatcttcttgactctgtagtattctgtatacttcagtttcaacttcttgcaatggccttgaattttacgtgtaggtttacctgactcaggaatccttccctcatagtttttccacaaaacctctttttattaaataaatcatttattttggttatgtgttttctctgttaaattgttctaacggtgacacaaagaaaagtagtttatatatgtcattatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctggtattacaggcgtgagccaccgcgcccggccgacttcagtgttttttaaaatcacaaaatactacattttttctcatgtattatagatatatcaaatgttaaacatgctaaaagcttgcttttgttttgaataccataagaaatcagtatgtttagaaatagtttcatattcaattacgctgtttagagttaatattgaattatgaatattgctctatttagctttattattgtattatggatctggagttaatgatttggaagtgttagctgcctaattagtagaatgtatcttatttctatagaataaaatgagtcattatggtcttttcacatgaatgatactcatttccaatcaacctatgcagcaaatttataagtataaaaaactgttgctgattctaaagcaagttaatatatttaaagaaaaggtcttaaatatcacattggttcaacaaatatttattaaatgtttactgcattccaggaattatgctctttgctaggagtacaaagataagtaagttcctattttcagcttcgagtttagaagagatagatttatcacataatttcaatgtaagtgacacataaggaattaatatggaagactaggataagggtaattattttcaaatcaggtgctttaggagaagtcttcctgaaaaattagtggttgagcacagtcttgaagtataatagccagatgtgaatttggagggggcaaggatgggcattaacagatggagaggatggtaaagatgaccacatttcaggcagggagaacagcgcatcatgagcaaaataatgagtgtgtaacaacacagtttatgtagcaaaactacaaacaacctaacattattaaaacataaggggtaagatgaaaagcggttaaaaggctgaggttgggaggtgataacgctaatagctagcattctttgaaagctagttaatatacaccaggcttgtcatgcatgatcacacccagtcttgacaacattcctctgaggtgtataatcttacattgctcttattgtcctgcctgcctccctacaaaataattctgtgatggcgtgatatcagcagtgtgtgccattaaaaactgaatgggtacacggtaatgtagaaatgtcactggaagcagagaaactctctacctagagactgccaaaggtgacgccaccacactcttaggccaggctgtgaagtatacaaatacagacacttaatcttgtcactgttccagagttgattctacttggaggttgcggattgatgataaccacatttacaggagactgaaatttaaccagaatttttttaggcaatagagacatagcccagcatatgtgagcagaacatagggattttgatgaaaacaaaaacaatatgagtcagcagaatgatgtacttggccagtaagataataaaatcaagagggtgaattaacagaggtgtaagtatttcaaggtgagggaggtggacattctttcctaccttgcatttgttaaaccacagagtatttgagagagagagagatgtggacaccaacccatgttacatgaagataagttgagtactttagcctgaaagaaggaatgtggtcttcaaataacatttatgtggctcttgaattaatttccttctgtccaatctgagttttcttcttagttcgactcttatctctagtcacttaaattacttcagcccaaattattgaacataagaaaaatccactctggcaggtttaaatagaatataattttagaggatattacgtagtcttgaattaacagagttgcagaaacaggctctagataacattataggactaacttccagaaccacacaactgaaatacagttccaattaaggagctcttatcccagaactatttgatcaaaatgtcttaatgaaaaagacacagttaatgccatcagttctgtaacaacatcacctctgttgccacctacatcagcaaaatgaatggcctattcgtggcctgcttcctcacatagttcacttctaaatctacacctcctatgcatgcattttattggtggagactaagccacatgcctgcactctagttaaaagggagactgacaaatgtagtttttatggattctacctttgtcaggtgggactgacaatgtgaggatgtattaaattgtagagggtatgttcaagtgatgttgagcagcaaaaaatgacacatgaccgctagagtttcctgaccggtctccttccttccagtcagatttttttcatcctttgagacccacaacctggtgaagacttctctgacctttccatctgccctgtgtttccaaagaatctgatacatgcctcagttagaattatttgttactactggaccataaattatttattcaacaaacatatatagcatttactaagtatcaggcattgttctaagtgctttataaataatatgtaatttgagtataaaaacagtctaccagattagacagcctagcatagtttctggtgtgtagtatgtgttcagtaaataagtgattcagaattttaaaagagaagaaaaaaggtcatgccacccaccttaacacacattattttgttgtacatatttcatgtccaatcattgaaggaaaaatttggcaaaaattaaactaccctaagatgagtggggctgtctgaggacgtagggagtacactgtcagttgaaatagatacatatgctgggtgtggtggctcacgcttgtaatcccagcactttgggaggccgaggcgggtggatcacttgaggccaggagtttgagaccaccccagccaacctggcaaagctctgtctctaaaaatacaaaaaaattagctgggtgtggtggtgcgtgcctgtaatcccagctacttgggaggctgaggcaggagaatcgcttgaacttgggaagcggaggttgcagtgagccaagatcaggccactgcactccagcctgggcaacagagcaagtctccacctcaaaaaaaaaaaaaaaaaaaaaaaaaaaaaggaaatagatacagaacatagatgagcatctgtggaccacattatgagtgctatccaacctagtttctgtgattctactgtgattcaacaatgccagagcctatgagagagagatgaaaaagatgtcttctgccttctagtaagtcattaacaagtaaaatatccaaatgagaaataacattagatagaaaagtggggatagggacagtgatccagataattaggaagaaaggtcatgtatatatacacaaaatttataggtattgactatgaatgaatcatcataggagttgctgcagtggttgcaaatatagatttttgctgtcaacaaagttattattcaatagatagatgcaatttgtctacttttgaggattgtcttccacattctcacatatgcatctttaaaataactttgatgccaggcgtggtggctcacgcctgtaatcccagcactttgggaggtcgaggtgggtggatcatgagatcaggagatcgagatcatcctggctaatgcagtgaaaccctgtctctactaaaaatacaaaaaattagccgggcatggtggcgggcgcctgtagtcccagctactcgggaggctgagggaggagaatcacttgaacttgggaggtggagcttgcagtgagccgagatcgcgccactgcactccagcctgggcgacagagggaaactccatctcaaaaagtaaaataaaataaaataacattgatactgttcttcgccaattagtttatttactttatcaaaaaaaaaaatagaatgctcagaatttctgtaagagtaaagggataaaaatactgatttgttttcttaaaaaatttagatatgattcacataccataaaattcacccttttacaatgtgctcttttttttgctttttctttctttcttccttttttttttttggagacagggtcttgctcagatttccaggctggagtgcagtgacaggaacacagctcactgcaacctctacctcctggtctcaagcgaccctcctgcctcagtctcccaagtagctgggactgctggtgcacaccaccatgtccaggtaattttttaaaagtttttatagaagcgaggtcttgctatgttgcccaggctggtctcaaactcctgggcccaagtgatcctccttcttgggcctcccaaagtgctaggactttggcgtgagccactgtgcgtggccaaattcataattttttttttgtatattcaaagagtgtgaaactagcacaacaactttgagaacagttgtatcaccccataaagaaacaccatacccataatcagtcagaatccaaactccctcctcttctcccctggccctggcaacctctaatttattttttgtccctataaatttgcctatttgggacatttaatatgaatagaatcatagaatatatggtcttttataatgcttctttcacttagcataatgtgatttcaagattcatccaggttatagcatgtatcagtacttcattcctttttagagctgaataatatttcattgtatgatatgccacattttgtttatccattcgtcaattgatggatgtttggattgtttctactccttggctattatcaataatgctgctatgaacattcgtgtgcaagtttttgtatggacatatgttttcattttgcttaggtatgtaagctgggtcatatggtagataaatctgtttaacttttggaggaactgccagactgttttccaaagtggttgtatcatttctctttcccaccagcaatgtgtgagggttccaattttttcaattcgttgccaacatttattattttcctctttttttctagttatcctagtagaagtgaagtagtatctcactgtggttttgatttgcatttccccacagattaatgatgttgaatatcttttcctgtgcttattggccatttatatatcttttttttttttttttttttttttgagatggagtcttgctctgtcacccaggctggagtgcagtggtgtgatctcagctcactgcaagctctgcctcctgggtttgcgccattctcctgcctcagcttcctgagaagctgggactacaggcacccgccaccacgcctggctaattttttgtatttttagtagagatggggtttcaccgtgttagccaggatggtctcgatctcctgacctcgtgatccacccgccttggcctcccaaagtgctgggattacaggtgtgagccaccgtgcctggcctgtatatcttctttagaaaaatgcctattcaagtgttttgctcatttgttactggactcttgtctttttattattgagttgtaaaagttctttgtatatctgggtacacatctatatcagacatatgatttgtaaccattttcacctattctgtagattgacttttcatttggtgttgcattttgaggcacagccatttccaacttggttttgtgaccctgtcaagggtgtcttcatatgtcacaaggattaccatgaatttcaaaatgaagaaaaacaatttgtctaatcaaagtgttataagtgtatatatcacaaaataaaggtagatttccaactgaattaaagtttattgaacctcaaaacaatgtgttcttgtaactgaatacttttccttctaatgagtgacatttattaccgcaataccgctgtttctgcttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctgaacatgtgcatgtttagatgtaaaatgcttctttgtcttcacattatgtagaaaattctgatcttataatagaaatgctaggattacctagaaaactagaataataagtaatctatcttttttataattttcaagtataatataaaacagtatcgtacaccttaaatttataacaataaaaaatatttgttttcaacctaaagtttacttctgaacttaatgcatgactttaaatgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcagggaataattagttatgatggctggtgtttggctagggaggagagactgtggagaagctctcagattctggaagtaatattaaatgcaaaggcctgaagagaaccaaaccatgtgtgtggaggcagagaagaaggaagtgagagatgaggttgactttgttgaaacaaagaatgtatattggaaagagtaaaaaatcaagttgaaggatggtcttgaagtccaggcggcaaattataaattagtttgagcaaggaggtaacatgatggaagcagtgtttaagaaaaataaattcgataggtggataggctggattaggctaatggttctcaaactggaaagtacatgaaaatgcaaattttgtcctgctccaggaagattgtgattcaggtggcctgggatatggccaagaaatttgcatttttatctagcacctccagagattctgctaaggtagtctgagaagtatacttcacactttaagaagtactggattctgatagacttattcgggaagctacctaggagatttttgagtgattcagtgaggacttgtattaaagtcctcactttgaggctaggtggggttaaataacgagtttggggagataagagatttttagcttattttaataagggctggaagcagcctgtatttctagtcttggtaccaactctctcccctaattacccacactgttacttccttagttcagactgtcatcatttaacacccctgtgattgctgtagcctaccaagcagtctccttgtcttcagtctctcacccacccatgcatattctacactgttaccagttatcttgctccagcagtaccctcttatctgtggtttcattttctgtttcagttacctgaggtgcagcacaataatacattttgagagagagagaccatattcacatgttttttttttttttttttttttgagaaagggtctcactctgttgcccaggctggagtgcagtggcatgatcttggctcactgcatccttgatctcccgggctcaagccatcctcccaccttagcctccagaatagctgggactacaggtgtgcaccaccatgcccagctaatttttgtatttttttgtagagatggggttttgccatgttgcccaggctggtctcaaagtcctgagctcaagcgatccgcctgccctggcctcttaaagtgctgagattacaggcgtgagccaccacgtccggtccacataattctattatagtatattgttataatttttctattttattagctattgttaatttcttactgtgcctaatttataaattaagtgttataggtttatatgcataggaaaaagcatactatatttagagtttcaaaactatccacagttttaggcatccactgggtgtcttggggcgtacctcctgtggataaagagagactactatatttccctcctcaaaacattcaaatggctccctgttgtcctttgtgatctcatccctgcctgcttctctagtttcatctccagcttcgttcttactggtacctgtcttctatctgcataggaacacttggcaattccttcatgccttattctttaatacctttaaatcaagcatgttctatttttttgagctggaatgccgttttcttctttagtgtgtccgccaagctcctaaatatccatcaagattaagcttcctgtcagtcttagaagaagctgtcctaggtaactccttccttcccatagcaccatgtttatagctctattgttatatttaacatattttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtatagatactgtctgtgatgggaaatgataaaatatctttctggtagatctctagaaatagcaaacagaatttggagtagggaagagataaaactgaattacttttttcaatggcttctcgttctaaataactgttgcagaattttgtgaagcaaaataaattgtttttattatttagtaacaatgcatgaaacagatttagaaaacagctaaaatgattgattttatttcactacaagccaggaataatttatccacaggtagaaaaataagcattcttctgtgacaaaaagtaagaattgatatgattacatatgatagttggaaaatagcaaacattgtaatgaccagaccttataattttaaataagaggtaatttaataagttggcagcagcaacggctttttgggaaagcatttgtctcgtcatcagaagagtctgagtttgaatcctgattcactactcattcattccctgtgagcttgtaaacctctctagactcagtttcattcctttcttgaacacaaagttactgggtacttattagtgccaggcattattccaggtgctggaatgatgaaccatacagataatgtcttcatggaacttacattcaagatggggaaacagacaatatgacacatataaaatataatgacaggtaagcgctattagagaaagcagagagtgatcagggtgtggtattttagataggcgagctctttgggcaaatgacatttgaaaggagacctgaatgaaaatgggaagagccatgcaaatatctagggaagagagaacatcaagtgcgaaggccttgaggcaggagtgtgcttggagtatctgaaggaatagcagaggtcactgtgcatggagtggggtgaacaagggaaagtatgggggtgtttaatcccaagagttagggtgactaaaaacatatgttaagcatagttagtgggttgttaatttggaaaggtaagttcaggtcattttaggagagatattttgaagaattgtcactttaatagccagccaggagccctggaagggtttgagccgtggaacgacaaaatccaaggtgtatttggggaagagaaaggtagcagtggaaattggagaggttagacataagggcaaggagatcaagttgggggttgttgctgtagtttaagtaataagggtgctgaactggagtgtggttagtaggaactaaatggaggatatagatgagagacagagactgtggaagtaaaatatcccagcctcagcaaatgattttaaaagggcagaagagatgtatgaatcaataatgactgaaatttcaagcatgggtgaccaaaatgacttgagcattcatagagtagtcagggacgagaccgagtttggagtaaaagaagattgagttcagttagatatgttaatcagggagaaattactagaatcacaatagcaggagtaaaggtatcaccatgcaagaacatttatttagctcttacagcattagcagtataattttataatttggttctctgtttcaaactactgcttttaccattttaaatgtactctctgtatattgctgctgagactatgttgctgatcattctaataacatttacctgcttaaaagctgaagcctgaatatctttactaggtattgaaggccaagtatacttgtagatgattcagtggaccaagacagagaagagtgaatcattttggtggcttgtagtatcatttaccagataaacaatctgacataaaattaagaggtcatatttgtaccttttgcaatgttcctaataatctcagtcaaaaaaacaagcccataatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttggtgatcagatgaaaataagacctgaaactatttaatgatggtatattataagtgatcttttaaaaatagcacaaacactattaaagtaccaatttcagtcttttctaatttcacattcattatatgcaacgagtagctactttcccatttcctaatgttttaacactgcaagctaacttgtacattatacttattttggataggggtatctgtatatgttttgaaaggttttgttatttgaatttcccttcatttttggaacactatcgtatcagttccttcccttcccgtgcattgtcataaattgcattatttcatcatgccagattaaattcattgttcaatgaatgctgaaatatagattatgaaatattaacaagtcatcttaccttgggcatttggaaatgtctaaaagacagcatgaatgttagtattatgtttagacatgtattttgaaaattgattatattaatatttatgaataggggtcattatgttttataatctatcctgatattagaaatgaaaagatgtatatttcatgtatgattttgcatcacaaattcattagctgtgcattttgattgtgatcatgttggatatttctattgaggatatttttctgtgtgtataatcaggtaaaagaatcaatttaaaatctgatgcttgatataagacatttaagactagtatagccattattttttgtactggattggtttattttactaacaatggaaaaaattttgatcatctatgtagaatgaggtaattatatgatgtctttttttgtgtgtttttgttgttaagtaatatagtctctacaatatatatcctttaaaagctctgtataaaatttgctgttgccattataaaacttaaagtggcataacagagggattttttttatgaggcaatgcttcctctatccagatagccttgtcggcaggggaaaaagaggaaacaatcagattacaatcaatgtttagaagttaccttaggctagatgtagttggctcatgcctgtaatcccagcactttaggagggtgagatgggaggatcacttgagcccaggagttcaagatcagcctgggcaacatggcaagaccctgtctctacaaaaaaataaaacaattagctgggtgtggtggcacactcctgtagtccaatctcctagggaggttgaggtaggagaatctcttgagcctggaagtcaaggctgcagtgagccgagatggcgccactgccctcaagcctgggtgacacagttgagaccctgtctcaaaaaaaaaaagttagcttagctactgtatataaaattttgggcccttttctcatatatttgattccatttttcattttagttaatcaagtttcttctgtctgtttatctgttcggaaaggactgtttggttgaacaaacattagttcctttgaataagtagaataagataatcttaaaaagaaaaaggccgccttagatttatgaagtgtttcagagtgtttaaagcccttcatgtatttcctcacttaagctacgtgttatatgtatttctgtaggttcgtgcatcagtttttcagaagacattgcctccatctccaaattcttggaggctagttagagtctggccttatcccatggagatttttttggctgaaagctatatggacagtcttttgagtagtttgtactgaccaaggtatttcctgtcagtggtccactgatattcataacatttaaaaatgatacatgatattcataacttgtattaatatctagtttatatgcttgtatgaaatgctttctgggtctgcattgctaaataatggtgatgtgaccagtgacatttagagtaattttttgtactgtggtcaccataattcggataccatgattattacattaattgcatgtgcttttatagttgcagccataattacctattaaaacaatatagaaaaaaatgaactttaacagcatcaaagatattaaaagcatttgggttcattttttatgctgatctgtttgtaaatttttagtaacctgtcatggttcttttctttaatgaatttgtgatctaaggagaaaataactgcttgtgcaatgtaactcttgtgcttggagaacataactgctttgtatatttctggtaaatcatttatttttattgatgattatgatgcttttttggcagagtgcttatccactcaaagagctgttctacgaagtgtgattggtgtctgtatccaagatataacatgtattctatgtgtttatatatgtctctctatatctatttatccatctttctgtctatcctcccaaagttaaatgagcttaaataggttgcctctgtgttagaaagcagagaagtattactagagaactgaggctcttccccaaaattatttcagattttcttattgtgtggagtggttttgcttggaatgagaaaagctatgtgttaccggctgaattgtttccccccccctcccgccctccccaaatttgtatgttgaaaccctaacatatcagaatgtgactgtgtttagagatagggcttttaaagtgttaagttaaaaaaaaaaagatgcctttagtgtgagccctaatccagtctgactggtgtcctggtaagaggacatttggacacacagagaggtgccagggttgtgtgcagacacagaggaaaggccatttgaagacagagagaaaagatgaccatctgtaagccaaggagggaggcctcagaagaaaccaaacttactgacactttggtcttggacttttaatgtcaagaatggggagaggggccgggtgatgtggctcatgcctgtaatcaccaacactttgggaggccgaggcaggcggatcacttgaggtcaggagtttgagaccagcctgggcagcgtggcaaaaccccatctctactaataatatcaaaattagctgggtgtggtggcacatgcctatagttccagctactcagcaggctggggcacgagaatcactggaaccaaggcagaggttgcagtgagctgagatcgcgcctctgcactccaacctgggcaacagagtaagactctgtctcaaaaaacaaacaaacaaaacacaaaacaaaacaaaaaaataaagggacaacaaatttacaaaaataaacaaaacaacaaatttctgttgtttgtgttccagtctgtggtattttattatggcagccctagcaaactaatacagtatgtaacagtcattttgttgtatttaacactgaataatagtgaacttttagagaacactaagtgccaagaaccgtgctaggcaagcttcatgtaaaacctaatttaatcctcataagaattatcacccccattttatagattaggaaagtgtggcttagaaaagtaggtacattgtttggggttacatagtaagtaagtgggagagctgggatttgaatccagtcaggctgacttcagagcttggcctcttaaccaataactaagtaagatttggtggatttcaggcagttgtggataataattgacaccacaggtgttcatcctctctaacactgttaatatttagtctttcaccatgtgctagtaggcaattcttattttctgccaactggagaatacctacagtcatacctacaacacagagagaaccttgcccatggaaaagctgctacattacagagaattaaagacctctgtgcacgtgttgctcaatgggccaaaaatgactctgccgatatggtctttgtggctttcatagcagatgttcacgaacaggtaacatcaatgcagataaaccatatactcagcaatttaaatgtgaggaaaaagatacataaatattagaaagaatcccatttttagcaatggcctataattctaagccatttttcctgtgtctgaaatagattaaccattgtgcctcttcgagttttttttctatctgtgtgttcacctttcttatgcacgcttgccttttataattaatttcaattaaacattagttttgtttaaataatactgtgtaattaaaatgcttatgtgctctcagagggcaaggaccatgtcttaatacactttagacatttttaaatacactaggctataacagcaataaaataattaaacatcgttttgttcaatctctacatattcacaattcctctgacactgaactgtgtataaactaaaatcagaaagctgctagttattttataatgcttctcaaaacagaagtcctcttccattggaaatgcagtctagcatcttaaaatctttttttttctttcaagaataaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaagcaactgtgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttacatatgtatacatgtgccatgttggtgtgctgcacccattaacttgtcatttagcattaggtatatctcctaatgctatccctcccccctccccccacctcacaacagtccccagtgtgtgatgttccccttcctgtgtccatgtgttctcattgttcaattcccacctatgagtgagaacatgtggtgtctggttttttgtccttgcgatagtttgctgagaatgatggtttccagctttatccatgtccctacaaaggacgtgaactcatcattttccattttgtccttttatttttgaatatgtaactcactgccaaattttatttgctctaatttcttattttagaaatgtcaagcctacagaatcattgtaagaatattacaatgaatagccatagacctttcacccatattttaaaattgttaacattatgttatatttgctttatcattctcttttaaaattttttttctttttttgccttttctgagccttagttgcctatttgtaacactttactcctaaatacttaagcatgtctctcttacgaacagggactttctcctatataaacatagtttaattactaaatcaggaaattcatcactattataatgttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaaatctacttttctatcttatcagatacaagtcttacttcagattgctatttgaattagaatgcctttagccatcttcattttcaggcttccattgtttaaaaagtcatgatggcttatccttaactgttatcaagcatgaatctataaatacctacaaatgtgttttctaaaaacaaaaaaattatggtgtttacatatagaaatgtatgttgccatagtgttcaataatccagagcaatgcttttcagcctatcttccttgtaaaaagctgttcaccttaggcttttgtagcggtgctttgtaagttctacgtttttttccgattctgttttagaactctatttattttaaaaatttacaaaaatagcacccatgttcaaagacctcaaaattagtaacttgtaagaccagatgaattcatttttgtgtacaccccagaatgtagtttatctttgcatctttaatggcaaggtattctaagactgcaagagatgctattttaactgttaagatttgtagatacttatttgtgaaaatctggattttctttgtatgatacaactaaaacaaaatgtgtaaatcatctggatgttttgtttaataggactgtagctcttctataaaatgcctggtgttagatgttaatgtttattcaaatagtctcattgttcttttcgattaacttataaatcaatccccactaatggaacactactttaatatgcttgaaaaaatgtttagtcttggggaaaaaagctttaaaactactgatcttacagaaaatgtccatttcaatatgtaaatttagtatacccattatttaaaatgtgtgtgtgtgtgcgtgacacttttaaatgcatttgtatttgctatcatgggacattgaatcagggttttatttttttattttttgttttttatttttaattttgagatggagtcttgctctgttgcccaggctggagtgcagtggcacgatctaagctcactgcaacctctgccttctgggttcaagcgattctcctgcctcagcctcccaagtaactgggactataagtgtgtgccaccatgcctggctaatttttttgtatttttagtagagacggggtttcaccatgttagccaggatagtctcgatctcctgacctcgtgatccgcccgcctcagcctcccaaagtgctgggattacaggcgtgagccaccatgccctgtcgagtcaggattttaaaactagctctccctgatctttttttttttcgatgaagtctcgctttgcacccccaggctggagtgcagtggctcgatctcactcactgcaacctccgcctcctgggatcaagcaattctcctacctcagtgtcctgagtagctaggattataggcgcccaccaccacacccgactaatttttgtatttttagtagagacggggttttgccatgttggtcaagctggtctcaaactgccgacctcaggcgatctgcctgcctctggcctcccaaagtgctgggattacaggagtgagccaccgtgccgggcctctgatctttataaaaataagataaatggtgaaaattgggaattcttactgctcttatgtaaaaacaagaataattttagtggtctgaattgaagggtcatgagaagcagcaggtatactaagctgtaaatctgtgggactaaactataaatcgtggacaagtggtcaagcagcctttaggaaggcaacaatatcatggcaatactctatttctgagctgatgttagagtttgtattgtcaataagatcatggtaaagtttaaccacaagttttgcagcctttcatgtttcctccatactcgtggaatattacccttccaacacagacatttcccttttaatagagggttatccttattacctccaccacattcactatccattttatatccatatcttgatttctgcccttctaattagtctactttgagtaattaggataaagcatttctgaaatttcattatataagcattaattactgtctcttaggtctaaaataatttttcggtcacattttctaattgccaaaattattccttggatcgacattcatactatttttctacaaacattatattacataaataaaaagaaaaagtttatatatatatataagtattttatggatgaaggtaaaacatgagataatttccttatgtatggaacaactaatattaaattaattctttaaggttgtatttatagctctcttatgcaaggagaataacttaagcaaaatagtacaccagataactgttatgtggtaatagagagattgaattaacactaaaatgtgttaaaacacatatatttataaaatagacttaaatttcaagaaataaaattaatactgttgaaagaagtgtagaaatcatatagtgactttaaaagtacacaagttcccctcatttcaaaggtgtgaatcttttgtgacttttatactagtatttaatactatataaacctcactgtttattctaaatattttattttattttattttattgtagagacaatgtctcactatgtcactcaggctggagtgcaatggcacagtcttggtcactgcaacctccacctcctgggctcaagctgccctctcatctcagcctcctgagtagctgggactacaggtgcatgccaccacacccggccaattgttttgtatttttgtttgtttgtttgtttgtttgtttgttttgagacggagtctcgctctgtcacccaggctagatggggtgcagtggcgcgatctcggctcactgcaagctccgcctccggggttcacgccattctcctgcctcagcctcccgagtagctgggactacaggtgctcaccaccacacccggctaattttttgtatttttttagtagagacggggtttcaccgtgttataaccaggatggtcttgatctcctgacctcgtgatccgcccgcctcggcctcccaaagtgctgggattacaggcgtgagccaccgcgcccggccttgttttgtgtgttttgtagagatggggtttcgccatgttgcccaggctggtctccaactcctgggctcaagcgatctgccctcctccgcctcccaaagtactgaggttacagacatgagctgctactcctggccaatatttcttatttatttatttaaaatatttagtgagtgcttacagaacgtgccggctacttttctaggtactggggtgggggcagggagaaaaagacccctggggtatatagtctacttgggttagtgttagagtagaccattgataaatgtatttgttttgtaaggggatgggggaagccacattttctagttttcaatatacctttataaatggagcatttgctttgataaaattgcaattctgttaacgtctcttaaagtattttgtttctccacaagggattattcagtattaatcattcaatgcgtacgatcagtgaaatcttagcaggccaaggataactcttgtgatactcgtaaaacaaccagaacagataccactttacaaataaaggacggtgtggggatctactgtggtggttagaaaagccctgaatatctgatttgtgactaaaatgtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctcatcttgctaaaaataatacagtaacaggattagtatgtgtatcatctgtatgaattaaccatttatttttattaaaatactaagatccatattatgaccacccttatgtgttcattgtctacttgtttgaatcaagaaacattctggcctttgatttcttgtagttatagatatatggaattggtaatgttgattgaaatataacatagtccctttagcttcagtactttaggaaaaggttcctctgtccactataacatttctcaaacccatgtaaaaacagtagtgtaaatataagcatacacaattaaatgagtgaagtaaaactcattggtgtgactatcagggctttaaaaaagtgtgcagtttgaaaaaaaatgaaggtgattatatagtaaaacaaacatctgtctctttcctactatccctgcactatgtataggacttgcttaattagaaagaagaagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtgaggattaaatgtcagccattgctattgttgttgttaggaggggagttaaatggattttggttttggacagaaaaaatggatttggtttgtaaaagtaatcaaatataagcagaaatatctgctaagctattggagagactgaatagatactaggtgaaagggaagagtaagagttgttattttgtgagtccttgtttttgtttgtggttctatcacagaatacctgaggctgggtaatgtataaagaacagaaatgtattttctcacagttctggaggctaggaagtccaagatgaaggtgatggaatttcgtgagggctctcttgctgcatcctctggagggtgccacggacaatgccatgtcctcaacatggtgaaaggtggaagggtaaagagacaaaaggtggccaaacttgccttttttttttttttttttttttggagacagagtttcgctcttgttgcccaggcacgatcttggctcactgcaatctgcgctcgcctcctgggttcaagcgattctcctgcctcagcctcctgagtagctggcattacaggtgcctgccaccatgccctgctagttttttttttgtatttttagtagagatggggtttcatcatgttgcccaggctggtctcgaactcctgacctcaggtgatccacccgccttggcctcccaaagtgctgggattacaggcataagccaccactcccggccccgaatttgcccttatataatgggattagcctacccagtgggacatagcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagtagctgggattataggcacctgccactacgcccagctaatttttttcttttttttttttattttttatttttagtagagacgggtttctccatgttggccaggctggtctcgaactcctgacctcaggtgatctgcccaccttggcctcccaaaatgttgggattacagacataagccaccatgcccggccctagaaattagttttaaaggatattttacactagtttttcatcaggaaaagtatatcttgataaaatgtttttctaattttagaacttaaagggaaatgtataactacattaaagtataggtagtagtaataatcttatagctaattttaagactctgccactaaggtgttataattcttagctccttctcacacatttgttttctaacataaatgatgtgtaacggcagagatcatgagttacatgttcctcatttgccttgtcatatcacctagtgcaaacttctcacacctgtaacctggaatgataataatttatttacttctttgtctcttttaggacactgtgggatatttgaaggttagagcttggtttctatttctatgccagacaaatcttacatagggtttgatacttagttgttagccagtaaaaatctaggacggctcctacaagaaacatttaaagggtttggcaagacctagggccaaccacctcccaacccgtccccaccctccaaaatgttttgaggaaaattaacacccctattattattagggaagcatgcaaattgtgtaagtaaaattataagtcagagaaaatcgaaatgtccatgtggaatagttaacatctttttgtttctgttatttcagggactgtcatatccaagaggataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggctgccttatgctgtgtccctcccacgaggggtcacatagaacactcttttccttcagcagtgaaaatgcagcaatatatgtgtgatgcacctgcccaaggaagcccattagagagtcagtgcccaaggtttttattgggggccggttatgtagacacactctgtttagcatgtaccaagatttcagactccccaaagtaaagcagatattcaatatagactgcattgtttgtacaaacaggcatagtaaaccatccttatcagctaaggagcagtggggacactccccaaaatccaggttcccagataccagccaagggccaactttgcatgcaagcctttctataaatagcagtagtaggcttgctatgtccacttttctgcatagcatggctttgtatgaatactgctttaggcgggagaaggaaactgtatggcatttctttcagtacttagtcttaggctcaatttgttagggagattaaggtttcttttctttgttagaggtgcttctaatgtcttggttgttttaagtgcctgttcgtcgacttgcatcattgctgaattccttttttgaactttatgaatgtaccaaacatacctgatccccactcccccaactagagcttgaaagcttgctgaaagtacagggcttaaactccacgtctccttgcaaatacagtatctaggcatattctctgttgattcctggtttcaggtagttgtttgagttccatataatattatgttggcttttattcagatcgtgcaattttctttattttggttggtgggctggggtattcatagtgcaggacctaagaaagcagtaaagcaaagaaaaaagtgagaattccagaaaatctgggtatattattatagtatcacatgtcctaaaatgttcaaaatttaatttcttttttgttttttgtttttttttttttgagacagagtttcgctcttgttgcccaggctggagtgcaatggtgcgatcccggctcactgcaacctccgcctcctgggttctagtgattctcctgcctcagcctcctgagtagctgggattacaggcatgtgccaccacgcccagctaattttttgtatttttagtagagacagggtttctctatgttggtcaggctggtctcaaactcccaacctcaggtgatccgcctgcctcggcctcccaaagtgctggaattacaggcatgagccaccatgcctggcttcaaaatttaattgctgagctgtttagatgaatccctgatagcatctccatggtgattgttagaaaatcatctttgattactgcttcatgtgtttttctgtaataacacattttctgattgtaaaggtttctatcaattggtcattaccttgttgcttttggaagaacaattatggctgttttatattcaacagaggcccccttatcagaaacagtattgtcttcactttgcaaataattgcagtattgtcttcatttttgcaaataaagagggaaaaaaaatcctatgtatcttagagaattgtgggtgtcaactcaggttctcacccagttaattgtacgttttgaaaatttaaaaaaaatgaaagggctattgacagtgagatgtgacagctaacaggagaaggaggaactataaaaatatagtagtcttcagttgtttcacagagaggaaaacaggcccaggctcttcagtggttttggagggcagtgctgtatgattgcgcagaatagaaattgatcttgatgaggtattatcaagaggagattcaatgtactcctcatcagtgctgtctgtgtgtaatattttcaaaaagttttcatcgggaatggttagctttctccccccttttagttgttatacttaaagagatatctttgacgtacacagcacacattcatggatcactgattatgcctgataaaggactcattgtattttgctctctttatgaaaactcatggaaaaaaataggtatctataacttatttagcacttagtataatcaacaatgttatgggtacaacaacagagaactacaccaaatgaaagagggagtttccagaaatatttagtaaagtttggagcatgtttttcatgctcaccatttccccacattaatatttctgagattaatttccaaagaaaataattggtcaccaaatatattgttttaaaaaatgtttcatgtttttgctgaggcaaagaagtcttaacactttgtggagaaagggaaggcaattaatcattgaaataagataaaagatacttcagccacttgggaggctgaggcatgaggattgcttgaacccaggaattggaggctgcagggagctatgatcatgccactgtcccccagcttgggtgacagtgagactccttttttttttttttttgagactccttaaaaaaaaggattaaagatgcttgaaccttggtgccatcccatggggaggaaaaaacccctatttttcagatttctgcagtgcagttctttggctagctggtagttgtacttgattaagtagaagagggatgatgctggttttattacataatggtctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtcaaggaataaacataatgggatggcagtagaatccctttataatgctgctgttacatggacactatctgttatgaggactgattttgctatatcattttactatatagagtaataatttcaagagcaataagttttttaattttttattttttgagacagggtctcactctgtcgcccaggctagagtgcagtggcgtgacctcggctcactgtatcctctgtctcccgggttcaagcgattctcctgcctcagcctcctgagtagctgagtagctgggattacgggcatgcgccaccacacctggctaatttttgtatttttagtagagactgggtttcgccatgctggccagcgtcgtctccagctcctgatcacaggtgatctgcccacctcagcctcccacagtgctgggattacaggcacaagtgaccgtgcccggcccccttccactttttaaacaacagaaatgaaacttattaagtaggggccttcgatctggaggctgggaagtccaaggtctatgtgctagcatattccttttttggtgagggcccttttcctggctttcagactgttcccttctcactgtatcctcacatattaggaagaggaagctttggtgtttcttcctcttataagggtgctaatcctatctggggtttccaccctcatgatgtcatctaaacctaattacttcccaaagatcccacctcctaatacaatcacattgcaggttggacttcaacatttattttgcgggggacataaacatagtccataattggtgttttcataaaaagaccatatatcaaacagtagtgtggtgcacagtaaataagtgccatgggcgttcagattagagaaaaactattgaggtgagacagctagtaaggtagaaagacagacaatgtgttgttcatttatgtatctggcttaatctgttcaggctgctataacaaaataccatacgtggattagcttatacacaacagaaatttattgctcaaagttctggaggccaggaagtccaagatcaggatactaacagatttgatgtatggtgaggacttactctatgcttcatagatggcaccatcttacaaccttcttacctgacaaaaggggcaaacaagttcctttgggtctcattatgtggcactaattccattcatgaaggttccatcctcatgaaatagttgcctccccaacggccctaactcttaatactattacattgggattaggtttcaaaataaattttggggagacataaacattcagaccatagtagtattcttagtgccgagtacaatgcctgaaacaaagtaggcattcaagaaaggtatgctaaattgaagaattaaaaatcatggaaatagatattttgaattggcaggcatcttacaaatcaggtagtccaagttgcccagaccatttcaactccgctaggaacattaaaataacacaaagccattttacactcattaaattgccaaaaaaaaaaaaaaagtctgataataccagctctcattttctgctcatgagactgtaaataggtaaaatcatgttggagagcaaattggcatcattaactgaagttaaagataactctatcctgtgatataacaaatctcatttaatatacagactctagagaatgtctcacctatgtgattgattgtattagttttctggggctgccataacaaactaacataaactcggttgcttaaaagcttagaaattcattgtctcatagtcctggaacccagaaatctgaaattaaggtatcagcttccctccctgtgatggctctaagaaagaattcttccttacctctttcagctttggatggatccagagattccttggcttctggctgcataactccaatcttttcttccaaattcgtgtcatcttctgcttttcctagtgtaactcttctctgtatgtcttttataagtttatttgtcattggatttagagcccattcagataatctaggattgatctcattttgagatccttaattatatttgcaaagatcctttttccaagaaaagtcacattcacaggttccatgagtttgaatatggacattttttttggtggccaccattcaacccactatttcagcaaatatttaaagcagtggtctgtaccaaaactaactatgacctccctgtcatttgttctggtcttctagttccttgtaggtcacaggttatctcactgcaacttcagtaataaaaaaatttgagggaaaagtgatagtagctttatttcattacttatatatttcttgagactagttttatggcctggcatatagtctattctggttaatgttccaggttaatgttccagttatgcttgaaaaaaaaggtatagtctatatttggttaaagcatttcataaacatcatttagatcaagtcagttggtagtgatgttcaagtctcctatttttttaaaaactattttctgtctacttattctaccaattattgaagaggcacagcgaaatccccaattataattatggatttatctatttttagttctatcagtacatttgcttcttgatttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgcatcttaacttatgacagtctagctttatatagtattgtatactttttctataagcaccttgcaatagcatccttatgtttgcacccccatcttttttattcttctcagacattttacttgtatatatgttataggtctgaccatacatcatattaattttttctttaaataatttgttttggggaaaaatagactgtaaacaatctcttatatattctcacactctatttcacacacatttctggcactcttcattcctttatgtagatctcagtttctatctgatattaattttctttagcctgaagaattttctttaagtatttcttatagtgcaggttttcttgcattggattttgcactgtatattttcagattatgtttgtctataaatgtatttatttcaccttcattttggaaagacattttcacaggttgcagatttctaagatgacagatttctctttttttttggtttgttttctttcagaaatttaaagatttcatccattgtcttctgagttccattttttttttcatttagaaaagacatttgggccaggtgcagtggctcacgcctgtaatcccagcactttgggaggccgaggcaggtggatcaccgggggtcaggaattcgagagtagcctgactaatatggtgaaaccccgtctctactaaaaatacaaaaattagcaaggcatggtagcacatgcctgtaatcccagctactagggaggctgaggcaggagaatcgcttgaactcgggagccagaggttgcagtgagcagagatcatgccactgcattccagcctgggcaacagagcaagactctgtctcaaaagaaaaaaataaaaagaggtttaattggctctgcagaatgtataagaagcatagatacttctgcttctgtgggggtcccaggaaactttcaatcatggcagaaggcaaaggagaagcaggtacttcttacatggaaggagcaggagcaagagacggagggggaggtgccacacactttaaaaaaatttacaacagtcttttttctttttcttcaatttttaagttaaagggtagatgtacaggatgtgcaggattgttacataggtaaatgtggagttgcattgtttttgataagaagtcaccaatcattttaaactctgttcccctctttgtaacatgtctgtctttctgactgctattaatattgttttatcattaggttttgacaaagtgattatgatgtacttttgaggtgtttttaatttttacaaatgtttatagtcagctctctgtatctgcatctgtggggtattggtgcaggaccccctgcaaataccaaattctgcagatactcaagtctcttacataaaatggtgtggtacatttggctctccatatctgcgggttttgatctgtagttggttgaatctgtggctgtgaaacctgcagatatagggagccgactgtatctcgtttgggattctttccgttcttaaattcgttggttagtagttttcatcaaatctggaaaattatgggccattatttcttcaactatttgttttgatctatcccttcaacattttggaaattttttctgtagtagatcactttatattgtccatatgtcactgaggctctgatagtttttttagcctttttttccctctctgtgcttcagattggtagttctttttaccattatcttaatttcactcatcttttctattgaagtgtctaatctgctggtaagccatacagtgaaaatttcatttcagatatggtatttttttcagttctcgagtctcatttgatttctttttttttgtagtttcatttctcttatttatgttaatgttttgctttatatcttgtatataatactaatatctgttttaaagtgcttacctgctattcccatcatctctgtcatgtctagatttatttccagtaagcaatctttttctgcttcttcaattacctagtaattttttgataggatgctagttattagaatgcgacattgttgaatgttggaatttggttgtcttaaaagagtattaggctttgttctagcaggtagttaacttacatgcaaatcaacttgatcatattaagacttgtttttaaactttgcatgaatctaaagtagcatttactctggatatggtttagtcctacttctaacatgtgtcctttttctgatttccaaatgctcaatgaagtctctcccctctgactgatcagaactcaaatgtctctcggtcctgtgtgatcttcagtgggtatttattcttctctggtagttcttctgatagttgttctgtgcccattctcgtggagtctcctctaaacttgtacggattgatattcagccagactcaactagactccactgcagatatctggaactgtttttttttttttctgtggggattcctcttctctggtaatgtgccctataaatccaagctgccactgccttcctgatctcccatctctcttttttcagttctgtaagcctgcagtactctgcatggtttgtcccctccctgcactgtaatgtgtacttccacacacaaaggctgggtggctatagggctcacttaatttgtttcctttctctcagggatcacagccctttgcagcctgttgcccaatgtctaaaaacagttgtttcatatattttgtctgattttctagttgtttacagatggaggtctagtctagtaccagttacttctttatggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctattaaaaatacaaaaattagccgggcatcgtggcgcgtgcctgtagacccagctactcgggaggccaaggcaggagaatcacttgaacccaggaggcagaggttgcagtgagctgagattgcgccattgcactccagcctgggtgacagagtgagactccatctcaaaaataaaataaaatgaaataaacctttcttaattctagaaaattttacatatattattatatataagattatatataaaatatataaattaccatgggttaatcctataagtttaatcagtaatgtagtgatccttgttgtttctacaaaataattcttatatgtgtgagagacatttacatgctgaattcgtaggtagtctgtttcaagtaaaagaaaaccattacaattgtgacctacttttttccatttgattttattcactaatagccatgtgttttgatagtgtataaagcaacattttattagtttctcaaatcccttgctatgctcttttgcagaatgaaatttttcactatttatgtcatactggagaatatagaatgtgaaaatataattgtccacttctcttaactgcaattatagtcgaatagtctcacaagatacatttttttttccccagatgtaagtgaagcctcttttgagttcagagctaaaattaaggactattttagattgagtccccaggacactcagtttttcattctaggtagcactatctcatttttacatttcctgtgttgtctctgtagatggttagaaaagcatacttcatcagaacgatgggttactgccagcacccctctgtgagatggttattaaaagcatgtcctttcctctccaattcagagtgcaaggttttcactgatgttatatacttgagctcttctgacacaagggagaggatagctaaaacagctctcaaagctgggtttatagcctttcctatcatttggcatttcactgaactaggtgaggtggttcttaatctttctctacctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacccagttcaagaaatagaacaatactgtctcttcccaattcctactgtccttgtcctccctaaagacttccagtaatttgacttggaacagtacagtttatttctgcctattttttgagttttacataaaataaatcacagagtatctacttctacctatctggcttctttcacccaatcccatgtttgtgagaatcattcacaggcctgagtataactatagttttaaattttgttcttctgtagctggggttgggcaccttattctaataagccgtaaatattttaggctttgtgggtcatatggtccctgacacagctttcgtaaaacaaaaacatcaatagatgatatgcaaatgaatgtgattttgctctattaaaactttatttgtaaaaataggcttcaggctagatttggcctatggactgtagtttgccatacatgcaataaataaatagaatactctagtatactgtagtatttcattgtatgaatatatcacaattagctgagccattcaaatattagcagacatttgtgtttttggtatgaatgcccttggaatgtggttttgtataaatatgcatgcatttctgtttggtatatggaattgcctcatgatagggtatatatatagggtaaacttaagtagtattgccaaatggttttccaaggtggttgtattagtcagcgttctccagagggacagaactaataggataggtgtatacatgaaggggagtttattaaggagtattgacccacatgatcacaaggtgaagtcccgcaataggccatctgcaagctgaggggcaaggaagccagtcggagtcccaaaacctttaaagtctggaagctgacagtgcggccttcagtctatggctgaaggcctgggggctgctggcaaatcactagtgtaagtgcaagagtccaaaagctgaagagcttggagtcttacattccagggcagggagcatccagcacaggagacagatgatggccggacgactccgccagtctactcattccaccttcctctgcctgcttctatcctagccacactggcagctgattagatggtgcccacccagattgagggtgggtctgcctctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgcatacatccatatacatacacatatatatttatacacacacacacatacacacacatatatatacacatacatatataatcataggtgtaagtgctatcccgaaaagaaatagagcagagtaaggagtaccatggggtgggtgttgcaattttaagtaggatgatcagggtgggccttgtggagaatgtgatacttgagcaaagatgggaacaaggcaaggtagtgagccaagaagatatctggtatggttatatttagtaggtttttttttacttgtttctcactttactcctgaaaggattcagtgcctgcattatttaggtggtcaaaactaaataaaaacttgatatattaacattttattcctttggtaatatagggggaccatgctaaagagaacttagtccactctggggaagtgctacgtcaaacttttgtttgactgtcagagctctcactggggtacctaccatgctgccacggggtggagtatttcactgtaatgtttctataccttatgaaattgacttagattgaaaatatcccaccactttagcccctgagcctgattctttttaagtgcagattttctaatctaaaaatcaaataagagagaatatgagaaggttcaatggaaaatcctaggtaatgtatagctgtgtaacagtgactctttggaaacgtttcttctgatgttattatctattgagtggaataatgctgattatttctggttagataaaggggaaggcagataagaccttagggtagcccataaatcacatagtataggaaattaccttttccaattatgtagaagctgcccttgttgctgactttccccattattcaccatcactataattgggaaaaccagaaagcttggcaagagaaatttgaatagcgagctcttagtttgttatgttgctgctatcactggtataaacacaggtgtagttttacaggatgtttggtgattattctatgcagaaacctaatagtcgtgtcacaaatttctacctcagtatccagaatcctataatctgttttgggaattttccttttacttatatgtaattttacagataaatcctcagttttctagtatggcatttcaccactgatgctgaaattagaacattgagggcttgtaatttgaaaatgtaaagattagaaattatatttcatagtcgggtgtggtggctcatgcctgtaatcccagcactttgggaggctgaggtgggcagataacctgaggtcgggagtttgagaccagcctgactaacatggagaaaccctgtctctactaaaaatacaaaattagctgggagtggtggcgcatgcctgtaatctcagctacttgggaggctgaggcaggagaatcactgaaacctgggaggcggaggttgcagtgagctgagattgtgccattgcactccagcctgggcaacagtagtgaaactccatctcaaaaaaaaaaaaaaaaaagaaacaaagaaattatatttcatttgtcctgtctatatatgatccaatgtacttttgctttctggcttctggtttctgcattttttttttttttgagacggagtctcgctcggtcatccaggctggagtgcagtggcgtgagctcagctcactgcaagctccgcctcccgggttcacgccattctcctgcctcggcctcccgagtagctgggactacaggcgcccgacaccacgcccatctaattttttgtattttcttagtagagacggggtttcaccatgttagccagggtggtctcgatctcctgacctggggatccacccgcctcagcctcctgaagtgtagggattacaggcgtgagccaccgcgcctggccctggtttctgttaaactggacatgccactttaacattagctcattctttatttgcttagccaattatatacatttttacccttgcaacaaagaaggataggcatagatgttctggacttattgttgaaggagaatccaggttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttattttagcaaataaactcttgaatccagcaatcccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaaaaaaaaaaaaaaaaaaaaaaaaaaaaaaagtctccttgtgatccttaaaaaaagatttgagccctgtttgaggttgatcttttatatgaattaaaagtaattatatctcaaagaatcagtgtaaaatgtatgtattgtttggtttcatgaccctttgttattacttaccactctaccactgcagttcctaggtactttaattcagttgccatccttcccactctctctgagctccataatagtgctgatttaacaaatactcactaaatagacaaaaccctacttaccattaattatgaactgaaatgaagcataaatgtggaataaataaaggatataatgagaaaatgtacaaaatgcttcaaatgcaccagtacccattatatatcactctaaaaattaatcattatattaaagttatagtgacaaaatgttttttactaagcagaagtaaaatttttgtgcattctttctctatcccacctcatattttgaatatatctgcaaagctggtttaaatcttgcttaaaattttatgttaaaaaatgtatgcacatcacataaacatggtaatgctcaattgtccattaaggaagacatttcacattttcaacatgaatgcttttctattctaaacatttttattaagccatttattcaaccagaggcctgcacagtaagcaatagtgtagttgtttttcaactagtactctgtcaggaacttagatagaaataccacattgagaaaaaaagtctttaacagaaatctaaaaacaatcattggtgttggactgtaaaattagtttagagttggattttatgactttttaaggatactacctgtaagttcttttactatttttaccatttctcttaaattttcttctattgatggttgttttaaattacgtgatgccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggttaaaaaaaaaaaaacataacctgagatctaccctcttaagaattttttaagtgaatagtacaatattgttaacgacagatataatgttgtataacaaatctccagaacatttacatcttgcatgactgaaactttatgcccattgcaccacaactctttttttttctttctttctttctttttttttttaatcatactttaagttctagggtacatgtgcacaacgtgcaggtttgttacacaggtatacatgtgccatgttggtttgctgcacccattaactcatcatttacattaggtatttctcctaatgctatagctccccctgctccccaccccatgacaggccccagtgtgtgatgtgccccaccctgtgtccaagtgttctcattgttcaattcccacctatcagtgagaacatgcagtgtttggttttctgtccttgtgattgtttgctcagaatgatggtttccagcttcatccatgtccctgcaaagaagatgaactcatcattttttatggctgcatagtattccatggtgtatatgtgccacattttcttaatccaatctatcacagatggacatttgggttggttccaagtctttgctattgtgaatagtgccacaataaacatacatgtgcatgtgtctttatagtagcatgatttataatcctttgggtatatacccagtaatgggatggctgggtcaaatggtatttctagttctagatccttaaggaattgccacactgtcttccacaacggttgaactagtttacactcccatcaacagtgtaaaagtgttcctatttctccacatcctctctagcatctgttgtttcctgactttttaatgattgccgttctaactggtgtgagatggtatctcattgtggttttgatttgcatttctctgatgaccagtgatgatgagcattttttcatgtgtctgttggctgcataaatgtcttcttttgagaagtgtctgttcatatctttcacccactttttgatggggttgtttgtttttttcttgtaaatttgtttgagttctttgtagattctggatattaaccctttgtcagatgggtagattacaaaaattttctcccatcctgtaggttgcctgttcactctgatgggagtttcttttgctgtgcagaagctctttagtttaattagatcccatttgtcaattttggcttttgttgccattgcttttggtgttttagtcatgaggtccttgcccatgcctatgtcctgaatggtattgcctaggttttcttctagggtttttatggttttaggtctaacgtttaagtctttaatccatcttgaattaatttttgtataaggtgtaaggggggaatccagtttcagctttctacatatggctagccagttttcccagcaccatttattaaatagggaatcctttccccatttcttgtttttgtcaggtttgtcaaagatcagatggttgcagatgtgtggtgttatttctgaggcttctgttctgttccactggtctgtttctctgttttggtaccagtaccatgctgttttggttactgtagccttgtagtatagtttgaagtcaggtagtgtgatgcctccagctttgttcttttggcttaggattgtcttgacaatgtgggctcttttttggttccatatgaactttaaagtagtatttccaattctgtgaaaaaagtcattggtagcttgatggagatggctttgaatctataaattaccttgggcagtatggccattttcatgatattgattcttcctatccatgagcatggaatgttcttccatttctttgtgtcctcttttatttcattgagcggtggttggagttctccttgaagaggtccttcacatcccttgtaagttggattcctaggtattttattctctttgaagcaattgtgaatgggagttcactcatgatttggctctctgtttgtctgtttttggtatatagaaatgcttgtgatttttgtacattgattttgtatcctgagactttgctgaagttgcttatcagcttaaggagattttaggctgagacagtggggttttctaaatatacaatcatgtcatctgcaaacagggacaatttgatttcctcttttccttattgaataccctttatttctttctcctgcctaattgttgtcctggccagaacttccaacactatgttgaataggagtggtgagagagggcatccctgtcttgtgccagttttcaaagggaatgcttccagtttttgcccattcagtatgatattggctgtgggtttctcataaatagctcttatgattttgagatacattctgtcaatatctagtttattgagaggttttaggatgaagggctgttgaattttgtcaaaggtcttttctgcatgtattgagataaccatgtggtttttgtctttggttctgtttatatgctggattacgtttattgattttcgtatgttgaaccagccttgcatcccaggatgaagcccacttgatcatggtggataagctttttgatgtgcagctggattcggtttgccagtattttattgaggatttttgcatcgatgttcatcagggatattggtctaaaattctctttttttgttgtgtctctgccaggctttggtatcaggatgatgctggcgtcataaaatgagttagggaggattccctctgtttctattgattggaatagtttcagaaggaatggtaccagctcctccttgtacctctggtagaattcggctgtgaatccatctgatcctggactttttttggttggtaagctattaattattgcctcaatttcagagcctgttattggtctattcagggattcaacttcttcctggtttagtcttgggagggtgtatgtgttgaggaatttatccatttgttttagattttctagtttatttgcatagaggtgtttatagtattctctgattatagtttgtatttctgtgggattggtgctgatatcccctttatcattttttattgcatctattcaattcttctctcttttcttctttattagtcttgctagtggtctatcagttttgttgatcttttcaaaaaccatctcttggattcactgatttttttgaagggtattttgtgtctttatctccttcagttgtgttctgatcttagttatttcttgccctctgctagcttttgaatttgtttactctcgcttctctagttcttttaattgtgatattagggtgtcaattttagatctttcctgctttctcttgtgggcatttagtgctataaatttccctctacacactgcattaaatgtgtcatagagattctggtacactgtgtctttgttcttattggtttcaaagaacatctttttctctgccttcattttgttatgtacccagtagtcattcaggagcaggttgttcagtttccatgtagttgtgtggttttgagtgagtttcttaatcctgtgtcctaatttgattgcactgtggtcggagagacagtttgttgtgatttctgttcttttacatttgctgaggagtgctttacttccaactatgtggtcaattttggaataagtgtgatgtggtgctgagaagaatgtgtattctgttgatttggggtggagagttctgtagatgtctattaggtctgcttggtgcagagctgagtttaagtgctggatatccttgttaacctgctgtctcattgatctgtctaatgttgacaggggggtgttaaaatatcccattattattgtgtgggagtctaagtctctttgtaagtctctgaggactagctttatgaatgtgggtgctcctgtattgggcgcatatatatttaggatagttagctcttcttgttgaattgatccctttaccattatataatggccttctttgtctcttttgatctttgttggtttaaagtctgttttatcagagactaggattgcaactcctctttttttttttgctttccatttgcttggtagatcttcctctgtccctttattttaagcctatgtgtgtctctgcacgtgagatgggtttcctgaatacagcacactgatgggtcttgactctttatccaatttgccagtctgtgtcttttaattggagcatttagcccatttacatttaaggttattattgttatgtgtgaatttgatcctgtcattaagatgttaggtggttattttgcccattagttgatgcagtttcttcctaccatcgatggtctttacaatttggcatgtttttgcagtggctggtactggttgttcctttccatgcttagtgcttccttcaggagctcttgtaaggcaggcctggtggtgacaaaatccctcagcatttgcttgtctgtaaaggattttatttgtccttcacttatgaagcttagttcggctggatatgaaattctgggttgaaaattcttttctttaagacttttgaatattggccccctctctcttctgtcttgtaggatttctgctgaaagatccactgtcagtctgatgggcttccctttgtgggtaacccaacctttctctctggctgcccttagccttttttccttcatttcaaccttggtgaatctgacaattatgtgtcttggggttgctcttctcaaggagtatctttgtggtgttctctgtgtttcctgaatttgaatgttggcctgacttgctagtttggggaagttctcctggataatatccttcagagtgttttccaacttggttccattctccctgtcactttcaggtaccccaaacaaacgtagatttggtcttttcacatattcccatatttcttggaggctttgttcatttctttttactcttttttctctaaacttctcctctcgctttatttcattgatttgatcttcaatcactgataccctttcttccccttgatcgaatcatgtgttgaagcttgtgcacgcgtcacgtagttcttgtgccatggttttcagctccatcaggtcatttaaggtcttctctacactgtttattctagtcagccatttgtctaatcttttttctaggtttttagcttccttgcaatgggttcaaacatcttcctttagctcggagaagttggttattaccgaccttctgaagcctacttctgtcagctcgtcaaagtcattctccatccagttttgttccgttgctgtctaggagctgcaattccttgcaggagaagaagcgctctggtttttagaatttgcagcttttctgctctgatttcttctcatctttgtggttttatctacctttggtctttgaaatgggtgacctccagatggggttttggtgtggatatcctttttgttgatgttgatgctattcctttctttttgttagttttccttctaacagtcaggtccctcagatgcaggtctgttggtgtttgctggaggtccactgcacaccctgtttgcctgggtatcaccagcggagactgcagaacagccaatattgctgcctgatccttcgtctggaagctttgtcctggagggtcacccgcctgtattaggtgtcagttggcccctactcggagctgtctcccagttaggctacacgggggtcagggacccacttgaggaggcagtctgtctgttctcagagttcaaacctccgtgctgggagaaccactgctctcttcagagctgtcagacagggatgtttaagtctgtagaagtttctgctgccttttgttcagctatgccctgccccccgaggtgggggtctacagaggcagtgggccttgccgagctgcagtgggctctgcccagtttgagcttccccagccgctctgtttacctactcaagcctcagcaatggtggatgcctctccccctgccaggctgctgcctcgcaggtcgatctgtgctagcagtgagcaaggctccatggacgtgggacccaccgagccaggcgcgggatataatcttctcgtgtgctgtttgctaagaccattgggaaagcacagtatttgggccagagtgtcccgtttttttaggtatagtctgtcacagcttcccttggctaggaattggaaatccccctaccccttgcacttcccaggtgaggcgatgtcccgccctgcttcgtctcgccctccgtgggctgcacccactgcccaagcagtcccaatgagatgaaccaggtacctcagttagaaatgcagaaatcactgtcctctgtgtcgatcatgctgggagctgcagaccggagctgttcctattcggccatcttggagagctctctgtttttttcttttttttgagacagagtctctctgtcgccaggctggagtgcagtggcactatctgggttcactgcttcctcctcctcccacgttcaagcaattctcctgcctcagcctcccaagtagctgggactacaggtgcacgctgccacatccggctatttttttttgttgtattttagtggagacagggtttcaccacgttgcccaggctggtcttggaactcctgagctcaggcaatgcgcccaccttggcctccagtagtgctaggattacaggcgtgagccaccgcgcctggcctgaacaacaactcttgtatttctctctcaccccatcacctgtcgacaaccactttgagttttttttgatgagtttgactacttgaggtataaatggactcatgcagtatttgtccttaagtgactagcttattttaattaccataaagttagctatgttcactcatgctttagcatatgatagagcttccttattttttatgactcaataatattccaccgtatgtatgtatgtatgttttctttatccactcatccatctatggacatttagcttgttttctcctcttggctacaatgaataatgctgcaatgaacatgggagtgcagatatcatttggagatactgacataaattcttttggatcaatacctagaagtgggtataaggataaaagggtcaccatcttgctgttgtcattcccttatttgtctgtcttttgcatcagtatatgaagtaatagaaaattaattgaagaaggagagagatgcatatgaaaagatgctcaacatcattgatcatcagagaaatacatattaaaattacaatgaggtatcatctcacccaagttaaaatggcttttgtctaaaagacaggcaataacaaatgctggtgatgatatggagaaaagggaaccctcatgcactgttggtgggaatgtaaatcaatacaaccactatggaaagcagtttggatgttcctccaaaaatttaaaattgagctaccatatgatccagcagtcccactgctgggtatatacccaaaagaaaggaaatcagtatattgaagggatatgtgcactcctatgtttgttgaagcactatttacaatagtgaagatttggaagcaacataagtgttcatgaacagatgaatgcataaagaaaatgtggtacatatacacaatggagtactattcagccataaaaagaatgaaatcctgtcatttgcaacaacatggcaagaactggaggacattatgttaagtgaaataagccaggcacagatagacaaacttcccatgttctcacttatttgtgggagctaaaaaatcaaagcatttggactcaaggatatggagaatagaatgatgattatcagtggctgggaagcgtagtgatggggaagtggggatggttaatgtgtacaaaaaaatagaatgaataagacctagtatttgctagcacaatagggtggctatagtaaaaaataatttaattgtacattttaaaataactaaactaactaaacgtgtataattggattgtttgtaacacaaaagataaatgcttgaggggatagctaacccatttaccatgatgtgattattatgcactgcacgcccgtatcaccatatctcatgtagctcataaatatatacacctactatgtacccacagaaattaaaaattgaaaaataggcacacttccaggatcaaaaaaagaaggaaaaagatggcttaattattgtgagtttccaaatcatcagataaatatgccatatttaaatgcaaacaatgtcatattaactttttatatattggaggctattttctttcgggctgctataacaaagttatgttaatatgtcacccaccatagactgggtggcatatttaacaaaagaaatttatttctcacggttctggaggctggaagtctgagatcagagtgccaaggtggtcgggttctggtggtctgggttgcagactgctgacttctctttatattttcacatggtagaaggagggcgagagaactctctggggtccctaataggggcgctaattctattcatgaggtctctccacccttgtgacctcattacctctcaaagttccccccaatcacattgggggttaggatttcatcataaggatttgggggcacacaggcatttagcatttttgtaacaaaggaaaactatatactgtattcccctctgaaaattagtgaagtgtgttagctgttgaaacttctaagaagtctttggtttaactttctttcttttttttttttttgctttttttgagacggagtctcgctctgtcgcccaggctggagtgcagtggcgcgatctcggctcactgcaagctccgcctcggttcacgccattctcctgcctcagcctcccgagtagctgggacggcaggtgcccgccaaaacgcccggctaaattttttgtatttttagtagagacggggtttcaccgtgttggccgggatggtcacgatctcctgaccttgtgatcagcccacctcggcctcccaaagtgttgggattacaggtgtgagccgcggtgcctggtcagtttaactttctttaaacccagcatttcttaaatctctaggatgatgcaaaagtaattgtggtttttgccattaatggcaaaaccattacccagcaacctcttttggggttacccaggaacctcttttggggttgggggaatagtatccactaagtatccacttgtcttctgaggcaaggcactgcttttctactgcctacagttaggttagtgctgaatggtatatttaagtataaagtaaccccaggtcacatatggctacttaaatttaattaaaattgattaaaattattcagatcatcagtcacattagccacatttgaagtgctcagtagctgcaagtggctagcgactatttttattggacatatccataagaaagacacatattgggatccgttttgtcacctaacatccctacccccaaagaatttactgatttgttatttgtttttgtgattttacattaactgaataatgttacaaaactagtcttaaaaaaaatctgttgctgctttcaatataacaatgttgtatagcaatggtcccccaactttttggcaccagtggccgattttgtggaagacaattttaccacgggacgggcggggtgcggggatgtggggatcgttacaggatgtaattgttccacctcagatcatcaggcattagttagattctcataaggagtgcacaacctagatactttgcatgtgcagttcacaataggatttatgctcctatgagaatctaatgctggtctgacaggaggtggagctcagagagtaatgctcattggcccgctgctcacctcctgctgtgaggtatggttcctaacaagccacagtagtggtctgttgcccaagggttggggacccttgttgtagaggacagtgtgcactgttattgtgttttttgtatgaaaactcctatgagcccttttatttggttctaaaagttagaaaatcctttgcttctttgaaaagtaactgattatatttttatttccttttatttgggcaccagaaaacagttaaatctttgtcctaacattctttttaatctcattctattctgatttatatttttttctattcctgttttctctcgatatttgttttcatagttttgcaaaatacttcaaattccataagagcaaatcaggtataactgaacattagtgaattacagtcttttttcacaattcatcataagtggtcaacattcttggctgtccatttttgcagggcatttgatagttgagccatttttccattacaagtgtttctagtatcaatggttaagttttctgtattgtctgtaagctgtttcttgctcaggtatcttataatcaatagtacatgatacagaattcctgagaagtaggaatagaaaatctatttgtagtctgtgtttctccataaggctttagaagtagacgagactaagcagctttgtttctaattcagtatttggaacttattgtatattcattcatttactctttcatttattcattcattcagtaaatatttgttgaatgcctgctatgcactgagcacttttctgggtgctgaagatgtagcaagaagacaagaagacaaaaaaaattccctccctcaaggaactgacattttactgagattaagctcaaattccaattcattaaactcttaatttttgagatcattaaaagaaaagattgtctcttattggcatctcctctccacgtacaccgaaagttatttcatttccatggccttatttgctgtggcagtaagagagataaataggccaaatcgaactgggaggcaggaggaagaactcttgtccaactttcattgtattcaagaattcaagaatatgagtgagaaaaggctgataagaaatatagtttgttgatcctaggctgagtgcaatggctcacacctgtaatctcagcagtttgggaggccgaggcaggcggatcatttgaggccaggagttcgagaccagcctggccaatgtggcgaaatcccatctctactgaaaatacagaaattatttgggcatggcggtgcacgcctgtagtcccagctacttgggggaccgaggtggggggattgcttgagctagggaggcagaggttgtagtgagccaagactgtgccactgtactccagcctgggtgacagagcgagactctgtctcaaaaagagaaaagaaaaaaagaaatacagtttgttgatcctaaaatatttggagagcagatttatggtcaaaataagacatagtctctgagacctactctgttcttagaagtaatcaggaatatttatagttgattggttttcaaaacaaaaatgcaaagcagttaaatatatatttgctaaacttattgaacacttagtatatgacagtgttctgaatgctgaagatagatcaatgaacaaaacaacaaaactccctgccttggagcttgcagtaaagagtagaaaccatgagagcaagtaattgactaaggaagcaagacagtgagtgctgtggagagaaagtgctataaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgataatggattaataactttatgagtattcttatatagcaacatgaaacatgtgtatcctaatagaaatatgaacaaaggtattgaacatagtattcataaaatataagttacatatatgatgtgcatggtgtatatggtatgtatgagtgggcttgtatgaatgtggatggctgtgcatatattcagcctaattagcaatagaagaaatgactattaaaagaatactgcagtttaatagacaaaaaggatctaaaataatgatctgatatgtgagggtgcagagaagcatgcactctcatttcatgatggttggtttgtagaatagtacaacctttctggagggcagtttagcagaatgaaacataagcaatgaaaatatttatattcatgcctagcaattccatttctagaaaattgtcctaatgaagcagatgtataaaaaatatatctgtagtattcacttcagaattatttctagttgtgaaaaattagagcataaatgcccaataataaaggaattttaaaataattgtatgataatttaaataatctatataattatatgggagatgtttatgatatagtaaatgataaagcagaatgtaaaagatatgtacagccaatagtatgaccccaattttctttaagaatatattgcacatgggaaaaatgattagaccaagtgataaaatatattaacagtacgtctctctatgtgagaaattatggtgatttttaaattttcttctcttgcattaactctgttttccaaatttttaacaatgaacttgtattagttgtgaaatgaggcaaaaggaaaaaatgataaaggagaaagggttcaattatattatctttattctctcagtgttgcaattaatgatagaattaataagccctatttttgccttgtttaccaactttgagtttagcaacaggaactatttgtattccattatgtttataaaagatggaaatatattttctgttttttcttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaataagcttttccctccttcaccagtattaatgtttttctttctttttttttttttcttttttgagacagagtctcactctgtccctgaggctggagtgcattggcgtgatctcagctctttgcaacctccgactcccaggttcaagtgattctcctgcctcagcctcccgagtagctgggattacaggcgcatgccaccacgcctggctaatttttgtatttttttttttttttagtacatatggggttttgctgtgttagccaggctgatcttgaactgctgacctcaagtgatccactggcctcggcctcccaaagtgctgtgattacaggcatgagccaccatgcctggccgtattaatgtttttctaatacttccttaatcagataaaaatttcaatttgaaaaacttgaaatattgatgtaaattgtttgattactacatgtgttttcttttttttttttttttttttactattttgctaaagaatatggttagttataagttgatactatgtatatcttcatggagatttttaagtaggtttttttattggccctgtttatatgtgtaggaaattatgctaaatcacaaaactggaaacaagagctatttcttgctgtgtaagtcagtttatcaaaaatctagatagctgtaataatctttttttccttgttacatgagaacattctgtattctctatcccttaataatgattattttaagttatacttgaatgttccactggcattttacacttattatatctaatatggactttgtaagttttcgttattacctactctagtcactcctcatctgccttctatgtagtccttattactgttaacatcatcattcactcagttaaacaaatctgggtaacctgtccctcattccttcactctattctccagggtcaaccactcctccttatctatcagttcctgagtagtttcctgaatcttcaccttcatcttctctacatcctatctctgaactcatcctccagaatgccttcagaattacttttataaagcttagtctcctctctaccacttttaaaaaatataattcttttaattttgtccagtgttcaaataaaacactcctagaaagagtatttcttcatgaattcctttttcttatatcactatttggctcatactttcactgcatttttgtaatccaagtccccctaacacaaaatgagcttaaaatatggttattttggccgggtgtggtggctcacgcctgtaatcccagcagtttgggaggccgaggtgggtggatcactcgaggacaggaattcgagaccagcctggccaaaatggtgaaaccccatttctactaaaaatacaaaaattagccaggcgtggtggtgcatacgtgtaatcccagctacttgggaggctgaggcaggagaatcgcttgaacccaggaggcagaggtggtagtgatctgagatcacgccactgcattctagcctgggcgacagaacaaggctctgtctttaaaaaaaaaaagaaatgtggttttaatggttaaagccattaaaaaacccttaattatataaagcaaataataattacaattaggacatcagagaaaaatgcactttactatcagttaccaatatgtgaattaccacccttttacgttatctgtgagagtcaaactgtataccaccatgtaagttgaatatgtgtacactttgccttggggaggagctctaggctgatgtttctaaatggtgaggaacacaccacacctgatttgtaaagtcagagaaggctagagctggaatcgatcatttagtccaaaaccctcttaaaattttttaaaatttattttatttttattttttagagatggtatcttgctatgttgcctaggctggacttaaacccctaggcccaagtggtcctcccatctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctcatctcctcttctcttaatggatcagctcattctctcctattggagagaggcttcttgatttggccgaagtcttagttatcagcagcaatgagagcaaacagactggctggacaacaatttctgtgtttcaatgccagtgcctagtgtgatgttatttgtcacatatgcatgtggaagatgtcttggccaaataactttgggaaattttgcatgctctacacctgtcccctccctttgaagaatcacaatgcacattaacatattaaattatctgaaatgtcctatggtagaaaaattaattacctttattgaactcactgtttccaaatcttaggtgatttcagagcatttatcatcatccatggatactagtgtctcacaaaagagtttagaaagttggatgttataaaatttttatttcatttttacattgtagaattttctactcccctttcaataccaggcaaatcgatgtgatttctgtgaataagtaagcaagccatatacatttatacaaatatgcatcatttgatggaaaggcagcacattgttgccagggaaaattgtatctaaatgatgtttagatttttgtttggaatataaatggatagataaatgaaattattccacttatacttttaaaatgccactgacggaagaaaaaaaaacccatattatctcaatatgtattgtcaaaaagtccttgataaaatttagcatgctttccgattataaaattaatacaataggacaagtacttatttccttaactggctctttcttgttattcaggtctcagcttaagtatcactttgtcaaagaaacctttcctaacttcctgcatgaagtagctcccactccctattgtattagtctgataaaactatatattgcaagccaaatggcactgttctgtttaatgctaaaacacttgaagaattcccatgtgaagagccagactaggatgttcacaatcactagtattttttaggcttttttccccattttttagagaggaagggggagtgtgtatctgccaatgcaattaaataagagagagaaggaaataaaaagatttagaaagatatatgtaattttttcacattatgtgactatctgataaagtatgtaaaaatcaatagcatttacatatatatatgtatatatatatatatatataaaacaaggcaaatgattgtgtgtgtgtggtttttttgtttgtttgtttttgagatggagtctcgctctgtcgcccaggctagattacaatggcactatcttggctcactgcaaccttcacctcctgggttcaagtgaatctcctgtctcagcctcctgaataagtgggattgcaggcgcctgccaagatgcccggctaattttttgtatttttggtaaagacatggtttcaccatgttggccaggctggtctcgaactcctgacctcaggccatccgcctgccttggcctctcaaattgctgggattataggcgggagctaccatgccaggcctaaatgattgataatggaataaaaagtcctatttagtatagtaataagagagagtcaatgacataccaatataatttcaacagaatttttctttttcttttttttttttaagaaattgacaacatgatgtgtatttttatctggaagtaaacatctgggaatagccaggaaaaaactggaacggaagtgcactgaaggggaactagttctaccaaatatatatataaaaaaaggttaaagttataggattaaaatagtttattcttgtttataacagagtcaaatagtagaccataatatatgcaggaatttactgtatgatagatgaggcatttgaattcagtaaagatcagttattcaatccaaaatttaatttgataaaaggatcataaagttaaatattacattacaggctaaaaaatatatttgcaacacatatggcaaagggctcattatcttaatatacaaagattttttacaaaataaatatgagtgggccaggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcatggtggcgggtgcctgtagtcccagctacttgggaggctgaggcaggagaatgacgtgaacccaggaggcggagcttgcagtgagccgagatcacgccactgcactctagcctgggcgacagagcgagactcagtctcaaaaaaaaaaaaaaaaaaaaaaaaaaatgagcaaatgaaaacccctattaaaaaagtggcagagcccctgaaaaggtagttcatagctacagaaatacaaataagcaataaaatgcatgaaaaaggatttaacttcaaacagaattaaataattggagatgaaatcagcaatgacataacatttgaaaaaaaaagtaacaaattaacaaagttttaaaatgttcgataatggtataagagagaatatggaaagaaagctcttccttctattgacacagtttttttcttttgtcatctttttggaggggcatttcgtgatatctaccaaaattgggcccagcagttccagttcttggcacgtatcctacacgtaatcctatacaaatatgtgaaggtacatgtaaaagaatatcagatgaaatattgcccctcagtgaaagactggtaaaatctgctgttactcttcccctggcttagtgtgctccaaccacagtagctttctatctctttatgggacatacccagtcttttccaccttaagacatttgtactagctattctttcctcttgggatgccttttccctaggttttttacgtgactttttttttcttgtcattcaggtctcagcttaagtatcatttcctcaaggaagcctttcctaacttcccactacaaagtagctcccatttcccatcatagtactctgttttattgtcatcatagtagctattactatttaatattgtcttctatgtttacgtattatctgtttctctagaatatggaaaggcagaataacttggtaattaaaagcattgactctgtagccatagctgggttcaaattttggctctgccatttacagtctgttggcacttggggacaattctaacttaatctctagtgctttcactttttaaaaaaaatctgtgcaactgtgattaagaatagaacctacctcacaaatttgtgataataaaatgaacttaacatttaaaacacagcactattgaggacatggtagacactcataaaatacttgtagatcaattgaattaaattatcatttattcatttaaaagaatattatgaaaccatctcagtgaatgaggtagatctgtatgttctgatatgaattttcttcaaaatgtagtgtgagtgaaaatagactgtgaaggtaacctcaaaatctgggtctttaaacaacagagactcatttcttgctcatgttacatatctattatgtgtcagtgagggtctctgtctcatgttgtcctcactagtgtcctgggctccaccatatggcgaaaggaagtagaatattcagagtggcattttagatgcttccatctagaagcactaccctccacttatcacattgcattggccaaaataagtcacatagccacacctaacttcaaggagtaggaaagtacgatcctactgtgaccttctaaggaggagaaccagaaatgttgatgaacagcaattattaatgagaatgtaataattgagaaaaaaggtacaaaagagtaggtataaagagagcctatttttcaaagatgtgtgtgtacttggatttatattataaaaatgtatggaacaatctgcaaaactaatagtggtctgctctgggaaatgggatatttactttttacattaaaccttttgtactatttgatatatttttcaatgtggacatatattacttccataactaaaaaaaaaattgtctcccaactgcctctcacatatactttgacaaagtgctattgcaaatactattacaactcagtaaacatgggatggcttatattgagagaaggaaactgattcacaatgagagaaaaggggcagaaatagataggttattttctgggtagagaagtacagagaggggctcctaaaagaccagtggcaatactaaagttctttataaactatctagtagagaggattgtgtggtagaaatttacaagctttctagtaacaaagtttcctgggtagttaagtgccagacagtaggggcagaccacaaaaatatttttatatcattttgtatttggatagaagaaacatattaaggataatatatttctgaatagatatcagtgataaatttgaagattctgaactattgcagaagactgggaaagttccctgaaagtctccatttttccatgatttcataaaagttgctgttggcaatgattccagggcttttcccaacttggaaattcttagttttcaaagtactttaaaagtaagatataaaattattttaagggaaaatgataagataatgttttatccaactctgcttgccaaattatttttagatatatatgaatatttgtgtatgatttgcgaacaatggaagaagtattgattttagataaaaatcacttctgttttagatttttgttatttgtagtgacaccagtgtgtgtgtgacaccaacacacacatacatacatacaacataattagatatatgtacacctaattagctcccttgtttttactttttttaaaattccttggaaatgcctactttttacaggggaggcacaaatatggaagttctgtatggaggcacagatttagctctaaagtatgtggaatggtaaattgaaaggattttggaattaaacatttattgaatcatctccaaagtagtataagatatttgtatacagaaaatgctgtgagagaatttgaagcaaaattttctattatccctaattgctctttgtaatatattttaaatattgatattaaatatttatttttaattagtgtgtatttaaaactatagttaaggtaggaaattatgatttagtgtattttaaatatgtatttttattcctttcctcagccttctgttaaaatgagttgcataatgcttacattttacataggaatgcaaacagtcctattttaagtctggtcagaatttttaaaggattaaattcaggtatttaaaaaaatcattacgtcattatataaagacaagtctagaaaaatcagatagattcacaggcctttttacttactcagtctcatgacttttctcaggggtttattttattttattttattttttgggactgagtctcactctatcacccaggctggagtgcagtggctcaatctcggctcacggtaacctctgcctcctgggttcaagtgattctcttgcctcagcctcccgagtagctgggactacaggtgtacaccaccatgtctggctaaattttgtatttttagtagagacaggacttcaccatgttgtccactagtctcgaactcttaatctcaagtgatctgcccacctcgctctcccaaagtgctgggattacaggtgtgagccaccaccacgcccggccaggggtttattaacatatatacatacaccatgagaacactatattttgtatctcacattcttgcatgatcatatttaagacaacaggatttgttcaacattcctagacacctagtatgtcaaggaatgtttctacataagtattatttattgaaataagctgcatttagactatgctactcaccatataaaggttgactatgcctaatccaaacatctgaaatctgcaatactccaaacctaaaatgaaatactcattagaatatttctgatttgggaattttgggttagtgatgctcaactggtgggtataaagcaaatattccagaatccaaaaaaatctgacatctgaagcagttctggtcccaagcatttctaacagggatacccacactggactcgggtggtaatctgcagcagctagtgaggtagcattcctgccaaacaatttgagatacattttgaagtatttggaaataggtgtcatattctccctttcctgagtttctagtaattataagcttttcacttcaatagttactcatgtataatcagtgagtttaagaaaattccagatatggtaattagatactaacacaatatggtgaaaaataggaactaatatacaaacttgcagattctttatatatttaatacagatggaagtccttgtttaaattttaatagtatgatacattaggagaaaaggacatatttggtaaatctatatcatatatagtgtcagattttacaggataacttgtaaggaagggatttatgagaaaaaaaatgttagcggggccaaacaatgtaaataaatacatgttggcaaatgtgctcaggagtattttgtaaggaaggagttataaacattgcctttaccttttgattgtatttgcaaaacaatgattcttaatggaaactaaaatttaaagtgttgagccatgagtgctcaactttcattgcatactctgtcataaagcatgctggaaagaaacaaaaacaagcctactagttgatcagttatttattgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttatggccaagtctttgccttataggattatataatctaatgatttagagaacttttgttatctagagtttaaggtactcataaaatgctgtttggttatagaatgaattttctcttgataaatgactgtactcaaaggcatattgatttccatataattatatagctagttatactctattttattagcaaaacagtcttgaattttgcataatttaatgaatataattaatgactaactattcttccttcctctgataggctaagtaatcaggctgacctagcccgattcattatactcattacagaatagaaaaaagaaaagctgcaaaatagtattttgcatgatggctctatttttctcagtttccaatcttagggacttgactaatttcattttaaagcagtacaggtatatatatatatatatatatatatatatatattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggcaggtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgtaatttaaaattttctagaagccacatttaaaaagtaaaaagaaacaggtgaaattcattttaataatttattttatgtaatccaatatatttagtacattatcattttaatgtgtgatcaatataaaattaatgagatatatctttttattaactctccataatatgatgtgtattttacatttatagcacattttaattccaactagccacatttcaagtgattggttgccacatgtgactaatgacttccatattggacagtgcagatctagagtctcgatttatttcccatccctgtatccctgatgatatggcacactgtgaatagtgctattggcttatcaagtggtgcatacttccctagtaagggattattggaaaatccaggtgagaggagctgtcttctgtagttttggagagtaaatgcattcaatatgatcctgatcagcccataacctggggtaggggagcttacattctccactgggaatcactgatcttatttgacctctttatattctgcaagaggaaatgaggcccaccttcattccagggtccatgttctgcaataagcttggccctcttacatttctttctctcttgaagtagccttttcctgtgttgtttgttcattttgggatttttttttattattatttttgagacggagtctggctctgtcgcccaggctggggtgcagtggcgtgatctcggctcactgcaagctctgcctcctgggttcacgccattctcctgcctcagcctcctgagtagctgggactacagacgcccaccaccatgcccagctaatttttttttttgtatttttagtagagacggggtttcgctgtgttagccaggatggtctcgatctcctgaccttgtgatctgcccgcctcggcctcccaaagtgctgggattacaggcgtgagccaccgtgcccggcccattttgagatgttaatcagtttcccttctcttctagttttggatatctaatggaagattatcacatatcatgaatgatagttctgttgatgctatttctcttattaaatgttcattgccattatcttctttaaatctctaccatttaagtcacactgttgaagactcaactaatcagaaccaattgccttgcattttgaatgtgaactgcccatgaattctctggattgaaaaatattctccctcccctctattgattagtaatgtgttttttgttccttttcaacatatattctaaacgtttatagagtcctcttcactttcatgcttatgttatcctcttattaaataaagtaatgccaagcccatcatgtgagtgtttcttgggaattgagaaatttagaattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttccttttgttctgctacccattccccactaaccagaacacccagcactctagcctgattgttattcataatttcccaatgcactgtaaactttctgtcatgcgtgtccctgtgaagagaccaccaaacagactttgtgtgagcaataaagctttttaatcacctaggtgcaggcgggctgaatccgaaaagagagtcagctaaaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagcataaattgagtggcataatttatgaaatcctcaccctatgtggtaggttaccagagatttgtaaatagaggctctaagaggttaaatcatttgcttaaattacaaagtaaataagtggcggaatagcatccaaatatacatttttctgacttccccaatgcacatactctttcagatatgctaaaatgtaatttcaatattttctctgtaatatttgatactccattaatttcattaacaagcatatttcataagtagtacaaagatgaatttcaaaatagctctagcaataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaagtatttagaaagtcttattgatgaggtaccatttccatattcaaaagacagggatctgttaaccttttagtgaatgagacaattcataatttttccttgtttctgtctctgttaatcctaacacacaattactctatgtagggaagcaggaaactccatttacaatgattatttggggttaatttcatttaatggcattcttgacaaagatatgaatatggcaagaatatttttatattttacgtttaacctttgtaatttaatctttctaatttcatttgatataaagcgtaaatgaaagcaaaaacaccatttatagttgagtgtgaatttttttctttttttgaaaccagtctcactctgttactcaggctggagtgcagtggcatgatcttggctcactgcaacctccgactcctgggttcaagcgattcacctgcctcaacctcctgagtagctgggattacaggcacatgccaccacgcccagttaatttttgtattttttatttattttttattttttagcagagacagggttttaccatattggtcaggctggtctcgaactcctgacctcaggtgatccacccgtctcggcctcccaaccaaagtgttgggattacaggtgtgagcagctgcctccggccgagcaatacatttctttgtgtctctgcattagcgttatacttttttttttttttttatattgagagggagtttcgctcttgttgcccaggctggagtgcaatggtgcaatcttggctcactgcaacctccgccttctgggttcaaacaattctcctgcctcagcctccggagcaactgggattacaggcatgtaccaccacgcccggctaattttgtatttttagcagagacggggtttcaccgtgttagccaggctggtctcaaactcctgacctcaggtgatccgcccccacttggcctcccaaagtgctgggattataggcatgagccactgctcctggcctagtgttatactttaaatatttttatttgaatacctataattatgaaacctgcaatattaagcatagttaaactttcaaataaagcaaatgtataaatatatccaattctattcatattcacttagtccactttctcatttcacacatttaacaaagcaagcaatgataaaatatgcatgtcttgagtattataatttgcatttgaaactgcagaatcttctggctgaatgaatcaataatgcaaatatctttctaattagatatttagtgttttttagttgtattttgtaaaatctaaagttttgtgtacaaaatagtttttttttttttttttaaagaaatctgacagatcttttggtcctgtgtttcaaagtacattgtgaattttgactgaaatcacagttgtctttggtataccaaaattaagttctgcatagtacctattttagtgttacagtcagtgtaactgctggaatattcaggtctagtggaatcagtaattatgtaagcctttcttgttagaggatttcttggcttagatacatcccttatatgtgcattgccccttattgccttattgtcattctaattactaccactcctttgtccccatccccaccccatggccttcattctttgttgctatctttgtgagtagaaagacaaactataaggaaaacttgtatgtgagctgtgtggggggagcgggtgagttacagttatttctaatatctaaagagttgtgtagaagaattagacttgcttgatgaaggcacaaaaggaataagtagaaccaaggaataagttgctgtgataaaggcatgaaataattgataacccaagatgcctcgatttggacctgctgccttaagagatactgagttgaatgttaaggcagtgaagtgcaatggaaggaatctgtgagcttggaaccaggcagacctgtatttcaattttgggtctacttcttaaataatagctgtgtggtcatgagcaagtcactaagtgacagaaccttggtttctttatttctaaactgggagatgatgcttaccttgcaggttgttgtaaaaactaagacatgatgtgagtaaagccccttggcacagtgcctgtcatgtaataggtctgtctattattgttgttttattcattttttgagtgatcaaaggttgctctttaaaaaaaaaaaacaactctaggtttagtggtacatgtgcaagtttgttatataggtaaattgcatgttgagggatctggtatacagattattttgccacccaggtaataagcagaggacctgataggtagtttttgatcctcaccctcctcctacctgccaacctcaagtaggcccccttgtctgttgttcccttccttgtgtcaaagaccactctttagaaatgatgttgaaagattgtacaaggtagtgaactaatataatttgtattatcccgtttatcttgttgatatgattctatattacttttaaagatatatggttgactggtaatgagcattatccccttctcttgttattggtatactgactaggttagtaattcatttttatttttatctttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataatgggtttctgattttatgtaatgtacttctcagcccttttatttatttttttatatagctttgattctttgaagctggtatgtgaagcacaagctttatttatttacttatttagagacagagtctcgctctgttgcccaggctggagtgcaatggccggatcttggcttactgcaacctccgcctcccaggttcaggcaattctcctgtctcagcctcccaagtagctgggattacaggcatgtgccaccacgcccggataatttttatatttttagtagagatggggtttcgccacgttgaccaggctgatcttgaactcttgacctcaggtgatccacccagcttggcttcccaaagtgctgggattacaggcttgaggcaatgtgcctggccgagcattattttcaaagtgtgctcaactggagtgcttctttctcctaggatgcccactatttgtgtagggccaatacttaatgattgttttttcatgattgctattaaagatactatttttgttacccaccctgatgctcgtgcttcacataacagcttcaaagaatcagcgagcatttggaaatgtataaaatgactcctgtcttttgtcaggagtagaatatactgataaaatcctttctcatgaatgatgaagttgccagaaatttggaatacttttggactgacaacaattacatgataaaatattgtgaaaactatttgtgaataaataatgaaccaatactacttctgttcactcagaacaaacataatacagtggttcagaagagcgtagtaaccttcatattgcttaatagttcagtaaacttttaatgcctctgaaaatgcataatagttccttaagaaagcatggtaggataatcagaaaagactttttttttttaatttgacaccaaagggattcatatatgacatctgttcattttttccacttcccttcttctagtaaaatacctagaaataattattcctagagaccatgtgatatttccacctttagtgtctagcctgcaattatttcaacaaagtcctcttggtacagtaaatagtaaaccccactggaccaaatcctaatagtatagtattggctgccatagtgtaacacacatggtatgtttacattaaattggtctcatgtcttaaaaagcatttgtctttatatttagtatagatacaatctagagatagattaactggctagatgatgatgataataataatagctaatctttattgagcacttactatgtggcaaacattgttctaagtgtcttatgtgtcttaattcacttgttataacatcccaaatgaagtacgtagtgtttttattccactttatagagacctaaactgaggcacagggatttaagcaactttcccaagattacacagctagttaagtggatgtaatccaggtaatttgattcaagggtccattctcataaccattatgtgatactgcttcatagccattgtgtgagactttaagagatgctgcagtgctttctcctttttcactacttcactatttctcgttcatagccctttgttcacagggaaaacataggaagggaaaaactagaagctccttgagtttcacctgtttattccagatttttatctcgtggtgtctcccattgtataaactgagatcagtaagaactgttattatgccatatgtttctaatcatagcaattgcttcattctctgaggcatacaacacatgaaattattgtcagacatactgattttatacgtttacaaatgctcgtttaaatagccattgaaatacaaacttcagtaaagagagtaatgtttggtttgcatgatgtctgaattctaagatttggcaatggagtaaagattttgcctagatcttatctttttccccccattctacagtgaggtacaatgataattgttatcatagtgatgaccctgggagagcattaacatcttttgttccctagaatgtacttattgaagcaggaatgtggatgattatgtttatgtttgattttgtttgtttttgagacagggtcttgccctgtcacccaggctggagtacagtggtaccatctgggcgcactgcaacctctgcctcccaggtttaagcaatcctgacacctcagcttctggagtagctgggactacaggcgcatgccaccatgccaggctaattttttgtatttttggtagagacggggttgcgtcacgttgcccaggctggtcttgaactcctgaactcaagtgatctgcccgccttggccccccaaagtgctgggattacaggcgtgagccaccttgcctggccggttgcttatgttttagatgtacagttgtccttaggtgtctgtggggaattggttccagaaccacccccccttgccaaatcccttatataacatggtatagtatttgcatataacctgtgcacatcttcttgtatactttgaattatttctagattacttataataccaaatacaatgtaagtgctatgtgattagcagctatactgtattgtctagggaataatgacaaggaaaagagtctgtatatgttcggtacagacaatcatccatttgtttaaaaaatatttttgatctgcaactggctgaatccatggatgaggaacccacagccgcagagggctgactgtatttttactgacaaaagtttaaacataaaagcaataaccaaaaaaggtagtttagtcacaaaaagtttaaagtgaaaattaaattaactacaacatactgtaattcatgccaaacagttgttcctcctaatcaatatttgaattttgaaagagaagtaattgtatatatattgtaagaattccactgtagatgagtcacagagcagattgatgatcgtatttttttgctatggtagttaaaactttttattcagatttttatttagtgctaaatgagttcaaaatgtatattacctctctggaaaagctcttatgttagactgtcagctatctagtccattttatattttcaacttgaaaaatgtttaaaatgttaatttatttcaattaaaatttaacaggttgaaataaaatgaacatcagatttctcttttgattcactccaattcagaaaaacaacttttgaaatcttacaatgtggtaggcactgaacgtttcaaagactgttaggaaatggttcctgtgttttcaagctttttccagtggccagttggtcacatttatcaaatgtactaaaactatgtttttagacatactctttaatatattcatgtgaagtttacagaattatgtttgaacacaatcctttttgtaggtgttcacagtttctatgaggttttacttcactggttttcatgttatcttcataatagcattttaatgaatatttatttctacccaactccttactattacagctggagggagctgtgctacaaagagagcactctctgttgagagaaacttggaaagttgagttaacatattggcctgggttgctaatcccaaagaacaggaagtcttagggctagagtgagggaggagattgggtggaaggggtatagtctgaagtctccaaagcttagagctctgacagcctacagttttattttgcccttccaatccatccaatgtgactcttttgacattcttaaaataattgagaaaaaatttctgatatagcttgtaaattctgctaattgatcctttagtaaattgaccatttggcaaatagtcttttctgcgactacatcaagagtccctgttgtcaaagaaatgccttagcaaatggaagatataaataatacctttaccaagttacaggtaaaaaggtgccctattaattaagtctgattttcaaaataacccactgaagagtacagggattattatccctaattaatatctgtatttaatactggaagattcagagaggctaagtgagttgccctcagttaaaagataatgaaaatggaggaatcaagatttgactcaggcattctggccagtaagtgtatttccattataccattctgaagataatcactttgtttaaataatttcatttttcacattttgagggctagagagatggggacgggagatgaaggagtactgaagtttgctcacttgatgacatgtttatgtatacttttcctgtacttaggaaatcaatttcacaagacattgttttaagaaattttaagcctgttattatagacatgaattaactacacactgttaatttagaaattattgttagagcagttattatttttgtacatgacagcattagaaaataatgaagttctaatattttgatttttatagctcacatccctattctgggtctcctttccaagttttcaaacttagcaggaccacagaatttcttgttttagactgctaattatcttaagacaaaaagggatcatcctaggttctgctggttctcacattaaagagaaatttccattttccattaatgtattcaaatacattcactttaaagatacctatactgtactgctaaagagattaccctctatgtcttattctctattttaggacttcagctttcagaaacagctgtaaaactttcttaagcattatgaatataatatttctcaactcatcttaaaacacttactatttactatttctcttattagatatggcttctgaaatggtttaattgcacttcaaaactatagcattttattgattttattttttgaaagctgctttatgttctgtagtgtttaatggaggataagttactagtcacatatgatactgtgcatacgctagatttaaatgtttagtgcttacttttgacaactacgtaaagaagatctatatactagttctggatttatttttgaaatggaaaattgtgcttttaaaattattatgggtagcttcagtttgtatcacagtataccagcaccaatacattactggtgtcatcttacgtgatgtatgaaaatttgaggtactagagtattggtaaaatgctatttacccctatattcttactcatttaaatccaaagctaagtctttctactggtactaaatattttacatcgcaatggaaaattttaataacgttgtacaaaaatatatagagaaactaacaaaaatccaaatgacctcattcatcttttaagcagttaaaggcagtggaataaagtgtgcaaaataatgacatgcaagatgaaaaccacctaaaccttattttcctttcctagcctagcttgttctattatgggttttatatgaacatactttgaaatgaaatccattagttgaaaaacaaaaataaaattcttaaccaagtggcaggcatatacaatagtccccccttatccacagggaatatgtttgaagaccctccagtggatgtctgaaaccatggatagtacctaaccctttatatactctctctctctttctctctctctgtagtgtatatatataaaaaaccaagactctctctctctctcatatatatatatatatatatatatatatatatatatatatatatccatctgatagccaaggcagctaccaaatgactaatgagcaagtagcctatacagtgtggatacactggacaaagagaggatttgtatgccaggtaaaagagtgtgggacagtgcaagatttcatcatgctactctgaatggtccacaatttaaaacacatgagttttttatttctgcaattttccatttaatatttttggaccatggttgattgcaggtaactaaagctgtggaagggtaaacaaaactatggataagtggggggctactgtaacataatctttggtttttaggtatatctcagatgtatctgaaataaacattgagatactgaatgaatattttatagcaaccatcttttctttaaatctaagcatccttcttaactctaaaattatgaatctaatttgtgttacattttatattgctaatttcttatttttttattttatattttatgttcagtccatctttccgttgcttggaatatttttctgaggtaattagaaatttatatcttctccttagatttttttctgaagtcttgttacagtgtgatggtttttcttcatttaattaattagagaaactatagtataactaaattcatgattgaacacattttatacaaattacaattgagagccgagggactatcttcagcattaaaaactcaaacattcctaactttactgtaatgcccttcaaattaggattgggtttatttagcatataagagcaagggctatgcagtacgtaaatacaatacgtactaaaaaaatgttttgttgcatattcatttatttattcatatatattattacaattttattgaattttgtacaaaccaatgcagcaataaaaaactatggcttagtctatatcctcatgaagatgaggatagactaagatataaatatagatatagatataaatataaatatagatataaatatagatataaaaccaatattcattttaatcatcctaagtgcttaaagaaaacatccaggagattagagggacctagtttgggaggacagggaaggcttccctgaggaagtgatatttaagctgaatctttaaacatgaataaggattagataagcaaagagaataggaaattttttttaatatggacaaattagagcttaatattttaaaaatatataaatctgagattggatattccgaactaacaattcaagttatttaaacattgtgagctttataacaacatggaaataacaatatatggcagttttagaaccttgctgaaaaataaccttggtaaatctaaattttatttaaaatgaagctgtgtggcacacattgattcaaactgtctgtaaatggagtattgagaaggaatatgacagccagcaaatgtcaatggcgactttgattaagaacagaatgttgaaaaacaaatacctaacaaaaactaatcaattaaagtgtgtgtggagtggagggaggaatagctcaaaacacgaaagatgtttataaggagccactatgatatctaattctccatgccatttaataagcagactagccatgactgtgtacctgacctgttgaccccaataactcattattcaagtgtttactagataattttcatccaacagcaaatttcactgtgcctattctaggtaactgtatgctggggccctctgggtgataaaaggtgttttattagctgcttccagacaccccagttctcacaaggttaaataaattgtatgcctgctaaatgagttagcaggagatttaaaaatagaattcaaggttttttttttttttttcctttgtgctttcttactgtggttacactatctttaaagtttgtgttggtttttcagcagcacaggtctagattagttgcatttgtatacttccaaagagttgcatatttatttgtcctaatatatatatttaaaaaaaaagttgttcagagataaagggtaaacacaataagcttactgatcattcaaaactgcctgtacctactcatttgctctttcagcaagtgtttattgagtatctgtggtgtgtggtgttgaagggttatccttaggaaacccaagaaaaaaaaatgtggtcttggccgggcgcaatggctcatccctgtaatcccagcacttggggaggccgaggtgggcggatcacttgaggtcaggagtttgaaaccagcctggccaacatggtgaaaccctgtctctactaaaaatacaaaaaaattagctggacgtgttggctggcacctgtaatcccagctactcgggaggctgaggcaagagaatcgcttgaacccgagagtcagaggttgcagtgagccgagatcgatccactacacttcaggctgggagacagagtgagactgcatcttaaaaaaaaagaaaagtggtgtttgcacttgaggagtttttgatattactaatgttatgaaaggtctgcatattctcacaagacatgaagctgaaaacgtaaaatatccttctgaattctggggttttttgttttaaattagggagatttggaaaatacctgctatagtatttcatttctgctgtgttctatgtgaatataatgtgaatgctcactgaatgtatatgctataccactggttgaaacttctgcaagtttattttcacttttgaaggtgtatattatttccatttttacaggaaagagggagtaaatacactcaggactaatagttgcttatttacaaaaatgttcagaaattacaagtcattactttaataaaaagtttatcatagtactgagtgtttcaaaatattatttctagagatattgtttattttcagagaaacaatctgttgaaatgtagatttctaaagtattttctgcatttgatatcaagtgtccatagaaaaacgcagtatcctttaggggtaccaagctaactaataagtgtgtttcacatacatttcgaaagttatgttgcttttattataagttggaattttcttcccattggaataacgagcgttttctttaaaaaggctgttaaagagaaaaaaacactgacccaggagtagcccaaacacctggattgtgatgctttcagcgatatagctgcatgaatttcaacagcacagtcacctagcatgaatcttgttttctttgttgttatctgccctgcatgtcacacatggttgttacgaggatcaaatgacataatatatgtgcaaatgcttgtaagttacaacttgttgtataatgtaaggtacacctattttctgaaagctaagctataagtattttttatccagtagagggagtcaaccatttgcatgttataaaaaccagatctaaatttcttctcctcttaaaataatttattcttaaatcaaagtaaatatttggagtaaagtatatgtgtgtgagaattcatttttattgatagaacagtgataaaatatttgatgaatacatgggtatttaataatatattacatatattgacaaaactcatttgattcccttgaagtacacttttttaattttgtattccagggtactaggtaaaatcattcatggtggtcattggttgtttatgctagatattggactatttcagccttgatgtctactgtgaacactgatgtagtggccagtggtgacaataaagtaaattgacaaccatgagtcagaattttagaacttggttgaaccttccatgtggcatggctgtagatgaaatgaaggctcaaacagatgtggtgaaatggcattttatctggcctattgacaatatccaaggagtctgctctggtcatgagaatgcagctgcatgttctttcaggcagacctttggcagaattgtggttccaggagatcagtctggtttggagcaaaaattcttgccaagctttgggattcaccatgcaggatgctatattcaattcctagagggaaaggttagcataatgccaagttagctagtgttcaagtcaggttcctggcccagcaagggacgtttaccctaagtacctgggactcaagacttaggacaggaaagataaatctagatgtgacttacaggcaatactgtggatcctaactattttgagttcccttgtcataattgagcctgcagacagtaggtgtcattgcctggaagcagccatttgtgaggctggaggaacatactaagaaacacacagctgaaatgtgacagatatgtccgcttctctctgcttcttttaactgatgtgggaatttgattgatacaaccaagaaaaacttgttatttttgatacctctgaagacaatccctgtattagaaatttaaaagcctggagtcacatgtatttgtgtctcatgttccaattgaaggtttgaattttgaaagagtttaggaggaagataagtcaatggttgactatgtacctaaatttattaaaattttaaattaaatatttagtaaagtgatgtgttatcaataccatttccttataacaatagtagccagtttgagaacatgatgaaaaaggtcacattcataatagtaaacaagtataagctgattttaataagcttaataggagggtatataacctacataaatctacagcactttgagagctatagaaagcgactagaataaatacgaagacagtgcaattctagatggataaaggccataaatatataaaatttctcttgtaaatttatacatctaacataattataaataaaaacaggaattttagttgactttattgaatttagcaagattattatacagatggaagaggaaactggcaagaatgtaaaatgccattttgagaaccatgggcaatattttggtgatgggggactaatcctataaaaagatgaaggattcacatttttaaaaaagggagatattataatagcacacacattcatgtaaataagtgggaatagaaagaaagttcaataatagattcttatttatttatttatttatttatttatttatttatttatttattttttgagagggagtctcactgtgttgcccaggctggagtgcagtggtgcagtcttggctcactgcaagctccgcctcccaggttcatgccattctcttgcctcagcctcctgcatagctgggaccacaggcgcccaccaccacgcccggctaattttttgtagttctagtagagacggggtttcaccgtgttaggcaggatggtctcgatctcctgaccttgtgatccgcccgcctcggcctcccaaagtgttgggattacaggcgtgagccaccatgcccgccctagattatgtttttgcatatgtatattataaatatgaactatgttttctgtaaggatagaaaataatggggaggaaatatacattccaataccattcattaagtaatctgcctgtaaatctggctccataactcatattgtgtaccaaaatcatagacagattaaaagtaaacattgaagtgaaaatattgtaagctttgaattaattgaagttacaaaaggacagatttacaactttgaataaataaaagctaaactgtatagaatgctgtaaaatataaaacactcagaaaaatacctgcaagtttattacacacgggattaatattgttagtatccatgcactgcatagaatgtgatggaagcatctaggtttggatagataaatgtgcaaaaaaatagacaatacgtatgagtggaaataaaattagtaaaatgggaaaaactttaacataccaattgagaaatgcaaaatttgaaaatgaggtatcattttccatcttttcaattggaaatcttaaaatggcattgcctaataccatgaaatttgtgcattactgtattatgctggtagcattaaatctgtttgaaaagaatttgacggaatataccaatccttgtatctattgacccctgtgatttagtattttggacaatttaccctaaggaaattatccaaaagaagaaaaaagtatttatttgcaggattgtttatactaatggaaaattggggtgggcagaaaccttaattccaagagggcaatgcttaattatgagccatacactcaggagtattatcaggtagacactagaatgacttagatatgctgtgtagaaaatgaaaacattcctctgatacagtggttaaaagaaattacacgtgtcatatgatgtatgctttcagttatgtacaatgtaattatataatcgtatgttagatgacaatgtgaaaactaagcttctagtctggtgggatttttaatgacttataaaaaattctccccggactttatggggtaaaaggaaaatgagaatggcagagatttttaaggttttaatgttatgaatgctaaagtattctgctaagtaaaaatgataataacttttattgatcatgttctatggaccaggaaccatagagtgttctgcatttattctttcgttctgaaatgcttgaaaactgaaaaggaggtttaggcaggatatacttgtctccataagatagaagggctgtgataggatggaacaatttgaatagtcctttttcattccattggaggttaaaaaaatctattatcagtaaagtaaaaattataaggaaacagatcttaatgctaacaaaacaaaacaaaacagcaacatacgtgtccctttctttgctttctccacctcaggaaattgacattgccgtacttccagatgtctaaactagaaacttgtgtttcatacttgattccttgcacttcctcattctctacttccaatctgtgaccacattctatctattctaactgctaaaatatttctgaaactcatctgctccttcccattacccctgtcacctttttagtttaggccaccatcctcatcaccttgattacaatagcagtctcctaactggtctctttccttccatccttaccccctttcttctattcgctacacaaatctaaacatgtcactcaccagcttacaaaaatcctcagtgatttcacttcgctggattaagtccaaaccccttaatggggctttcaaggtcttcatgacttatatttacttcaccagcatctgctccccagcaaataaattcattctccctttcctgctccttgtccctttccccaccccatctctctcagtcacacacatgcaaatgtacacacaaatacatgtacacccctacagccataccgaacttcttccatttccatgactctgtttcattctctctcatcactgaatcttccacggtgctgtgccctccacctggaacactctccgttacttgtccaacctcgcctgagctttctcttatgatctcttgttcttgcttatccttcagttttcatattagacattccttctcctacaaaggctttttggacatctgggttgcatcctcctatgtgctaccctaataccccattccataccctttatacttacattactgaaaaataaggaccacctgagtagcattgtacctttggtttactaccatatccgtagagttagcagagtgtctggcacatagtagatgcgtgctaagtattcattgaatgaatttgtatggtttgggcctgtgttgtcaactacttaagatttatatttttaacttcaaatttgagcactgtcttcttggtcatcatattattaacaacaagcacaatgccaaacacggtacattttcagtaatgattggaaatgaatgagtaactcagtaagtatttgaatgaatgatcattgtaatggtgacacctcactgagattaatgagcattcatcctttctttaagttccctgaagggaacttcatttgtctctgttttacctaacatagtgtcttacatgtagtagacactcattggataattaccttcaattcccaagactgaccactatgtacagagttccagctagtgctggcgttaattaggtgatcttgaccatatctggaatttgaacttgagctggatttctctgtatatttgtgtatgtgtgcctgtatgcatggtcatgtcaacatatattttttaaagacatagactggttttgtattatgtatacagtgaccattaaaacaatgccatcacactacaaccagtcagagttctcttcttgttgttggttgttcatttgttttactgtggttgtttttgccttggactttgagagaatcctggactgtaaacttttaaggcaaggtttaagtcttgtcctaatcattcactgtgtagtcaacaagaaggtgttaggacttgagaaaaaaaattacctgaaggaaatatatatgagaaacgctttatggggaaatttttttgtcttttctgcttgactgtagaacttcaggtgttgtgtaatacgtattctttcacctccacttccctctgtaaatgtgctttactcataaatgtctgtctataaagatgtgtcctgggtctttaacaagtaggaggtggtacatacttgaataaacatcctctaagtggttgaggttgaaaaggtgcaaatctttcctagttgaagtaggagaggctgtacctgctttgttatgagtcctttctttgtgttctcattattcctttttttttttttttttggttctacatttttttcctgtactattttgtacagctcctttcttatttttttctttcacctctcaactctttcattatcactcttttttcatttattgaaaccatatatccatgttttttgagtgactttgaccagaacagttggttcagctttctttttaaaataatatttaatgtatttcaattataaaagtaacaatctttaatttagaaaatctgaaaacaaaggaaattttaaagaagagagtatgtatctaaaatcctcttacttaggtataattatcattaacattgctataaattactatttagattttttacctaattgaaatcattctgtacctagagttttttttacctaattgaattttttacctagttgaaatcattttttacctaattgaaacattaggtaaacatttttacctaattcaaataattctgtacctagagttttgtatctcattttaaataatattgagtcaaagatgtatttccacatcattaaaatactttaataggccagacacagtggctcatgcctgtaatcccagcactttgggaggccaaggcgggcagactacttgagcccagaagttcgagatcagcctgggcaacatggggaaagcctgtctctcttaaaaatacaaaaaattagccgagcatggtggtgcgcacctattgttttagctactccggatggggaggtgggaggatcgcttgagcccaggaggtcaatgctgcagtgatatgtgatcacgccattgcactccagcctgggagacagagtgagaccctgtctcaaaacaatttttaatggctgcataatattccattttaaatagataaagcttacctctttatttcccgatatttgcactgttcaatgtatttacaagtttctctgatataaaaatgatgtcatgaataacttagaacgtgaagtcctagctacagttcagattgtttcctgtgaaagattcctagaagtagcattatcaggtcaaaaataagtcatactttttgaggcactttttttttttttttttttaaccacatggctttccagaaatgttatgccaaatctgctcattgctatcagcattgtaaaagaatatccatcttaccccatgggtagggctttttagtttctttaacggtattgtagtttctttaacagaatattaacagaatactgttaaaaatggataaaaatggataactgtgtgaactgttatcaaattaattaaacaaagaatattatttggcatacatatttgaatcttgttctgaaggcagtgggtacatggtgtgttttcttacaattggaatgtcttgtgtgtgtgtgctgggttgttattctctgaaattgcattactgtgttaaatccccaaactaaagcagtgaatttttttgtaagttctgtatctttgtggccttgacaactgagccagtcctttggagaataagcaatcctggactgcattttaggacaatgagaactgccaaagtcatgagagagaaagacgaatggataggacactgaagtagaaatcagatgccctaggctttattcccacatccatttgtcattgtgtatcatggccaaatttgattaaagaactttcccaatctgtaaaacggggataatatgtctcaccttacagggatggtaaagggattactgaaatatttttttctaattcattttgtgttcttccaaaagagctctaatattcagaaccaaatactgaaatctatccaaaatctgaatggtagaaattaactattatactttcaagcattttaaaccccagtttattaagaacctaaccccttagtgaagagggacagatagtcaacagaagaataaacaaagaaaataccaaatagtaatgagcctccaaaagactaaaacattgagtgttcttttttgttaagatgccattttaacccatttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttattatattccttgactaagtggatctgcataacaatattaatacttgcctgcaacatgccccaatttttaaaataacctaaggaatattcaggttttttgtttttgcaagatttcttatttttcccaaagacatatttcatatagcagtcttttcctttgagagtgttttgcccttaattgtactagttggaagtgtcagaatagtgcattaacctactgagctccagatggctgacttttttttgttattttatcttgtcttgtttaaaggaatatagaattggcagcagagcccactaactgatgtcagatttggttagcataaattgtatgtttaatatcaagtaaacatgcacttaaaaatcatatgagttgtactttttattctttgctgtacaaaatcttcactgaatatatttgataagttgaaaggctcattcattttgtgagaaagtttatgagattactgattatattacttattgaaaatatttagtatctatatcctactttgggtgtagaaaaaagaaatgaagccttttggaggtatgtgtgtgcatgtctgttgaattgttagattatactaattttttctctgagaagtaaatgacatgctagaatagtaaattgtataatgtggaccatgaaaaagtattatttctaaaataattgttttgaggaaacagaaatgtgtgtttccttatattcaaattcacaacttaggtccttagaggtaagaatgctaccagcagaaacagatggttggtaatctgtaaaagtaatgccatcatattgggtaatgccatactgctgtttctattggcataacctctaactatgacatgatatatagcacttatgggccagaacattgtttgtacttttataaaaaccctacaaagtctatacgctcaagtactagctcagtattcttatcaggttgggtttttgttttgttttgttttgttttttttagacggagtcttgctctgttgcccaggctggagtgtagtggcatgatctcggctcactgcaacctccgccacccaggttcaagcgattctcctgcctcagcctcccaagtagctgggtttacaggcgcgtgccaccatgcccaacttattttttgtatttttagtagagacagggttttaccacgttggccaggctggtctcgagctcctgacctcaagtgatctgcccgcctcggcctcccaaagtgttgagattacaagcgtgagccaccgcacctggccagattgttctttcaagttaggataggactttggggtaagcagtatttcgtgatattcactgtataccattttagaactgaaattggttcatgcagcaaagatgaattatttatcacaaaaggcttgaataacctatacatgcatcactgctatagaaaataaacacatatgtttgagtttgttaggtaaaattagtttattgaaatgaaatcccccaaaatcaactttcatatattttttgaatttatatatactaatataaacaagtcattcctcttttaaatattaaccagaggagtatcccactaagatactatttgatttcaaatatgtcagtgttaactttaaatattttaattatactgtttaactacgtggcaacatagggtacacactatagcagcatctcttatacaacttatcaaatatacatgttaaatacaaaacccataaaatttaaattaacattattttaagtaataaatcatttgctgactctaaattgccaattacaatgtgaatatactacagtgcgggcacttttgggttctctgtgcctaccgtgccgtaggataacccaactgtgccactagtgttctctgatctatggttaaattttgattggtatagcatgctgcgatgtcatttggtctttattttggtacatatgtgttttcacactaaggccatctcattagccagaggtaatgaaagttgtacttcctggtaacagtgtgaatatatggatgctgagactaattggcaggacttggttataaggtagttatctagatgatccagcttatgcctagctttatcatattaagaaatgaaacttcagaattttaacattaccttaccagactcagggatgattaaaactatgttcaaggatcccagtttgagtaccattgctgtgagctccaggtatattgatctaacaaatccccgaacatagcatgttgtattatgacccaatatttattgtaatttctaactgaaatagccttatctacctttggtgaacagtttttacagctgggcagaccttcttcccccgcatagagtcaagtcctttaaccttcaaactcccttatcaccccctatctattttgaaggcacatatcacattgacagtggtctgcatgttgttgcttaccatacctgaataagctctgctgggatggtgaggatatatcatcgcttatctctgtactctcagtgcctggaacctcatgggaactcaattcatgctgactggtaatattctaatacaaaaatgataccatatgcacagtaagagatagatgccttgtgtctctgtagtctattttgtgaagaaaccgagaatctgtataatcaatgtgtgtgcagagaatatagtgaatgtgtgtgcagagaatatagtgtccaattaaaattttatgctttaaagaagaaaagcttttgctttagtatgcatatagtggcatattccaaatcatagattcaacagggcaggacctttgggatcatctagctcagtgggtttaaaaccttattttatttaacataagagcagcttattcataaaaaatcatatgtgggatatgaataaattagaagataaatgtgtaaatgccctcatttttgggggagcagagacttgggaagtctccccaggagccttccttttttgcacattccctactcaccctccaaggcaacctggaaaacacctcaaggaattccatggacccctgtgaaaataatagtcttctcaggccggacgtggtagctcatgcctgtaatcccagcactttgggaggccgaggtgggtggatcacaaggtcaggagttcgagaccagcctggccaatatggtgaaaccccgactctactaaaaatacaaaaattagctgggcgtggtggcgcacgcctggagtcccagctgctcaggaggctgaggcaggagaatcacttgaacccaggaggcgcaggttgcagtgagccgagattccgccactgcactccatctcaaaaatactgctactactaccactactactactactactactactactactactactaatactagtctcctacctaaggtaagaatccttttccagcatctcagacctagtggcaggtctttgcttgaataatttaggtgaacagaaactaataacttcataacatgagcagtcaactaggcaattgttaacgaaagtactcactaaattaatgataaaataatgtataatggcaccaaacattagttaagtgcttattatataccagaccttatgtttgaccaggatccttatttcacccttatgacaagcctgaggagggtagatgctttattgttcccattttgccaataaggaacctcaggcccaggaagtcaagtaatcacttgactaaattcatacagctattaaggtaaggaatatttcagaaacttttgcctgcttttccctttttgttataatcctcctttggaagcaaattatgcccctttttaagatggttttgtactgtcctcagagggcgactctatagcctgggttctagccttgcttctgacagttagatatagtctcagacaagacatgacttctccgtgactcagttttcacagcagaagaaaaaatggttttagtaatattttccctgttgttagattcagatgaaatagtatgcaggaaaagttgtgaaagctgtttttgctatagaagtttaaggtatcctttatttatttattttttttcttgagacagagtctcgctctgtcacccaggctagagtgcagtggcgtgatcttggctcactgcaagctccacctccggggttcacgccattctcctgcctcagcctcccgagtagctgggactacagacgcccatcaccatgcccagctaattttttgtatttttttttttttttttttaagtagagatggggtttcaccatattggtcaggatggtctcgatctcccgacctcgtgatccgcccgcctcggcctcccaaagtgctgggattacaggcaatcccattcagtgctggaggcacacatccatttattcatgtgacaattagttacatttctttttatttttccttgttttcctatcctttggccattttactattgatgcactacctcccatcagcaggtagacaaggaactgataaaattcagtgtgttcattttgtctgatagcacttactaaaatgtttagaaggctagcgttttgaaaataatagggtaattttttgttttgtggaaggaatatttctttatttcatttacaatgtatagcttcattacctacttaaaatgcagtttatatctaggctgtaggatacatttataatctgcaaaagtattattaaacttgctttgttacactgtctaaagttactcttggaatcggatttacaaaatggtaaagcagagagggaaaccattttatttaaataccttcataatctttgccccaacacaacaaatgttggtaagtcttactgttgttcctatctttaaacagtacaatgaagagattgcctatgcgaaatacattggttatcctattgcacattatcattgatcaaatcctgcccattttttaaagtcactatttacatacatgaactttctttatttaaaatggtagtgggccgggcgcagtggctcatgcctgtaatcccagcactttgggaggccgaggcgggaggatcatgaggtcaggagatcaagaccatcctggctaacacggtgaaaccccgtctctaccaaaaatacaaaaaaaattagccaggcgtggtggcgggtgcctgtagtcccagttactcgggaggctgaggcaggagaatggtgtgaacctggtaggcggagattgcagtgagccgagatcgcgccaccgtactccagcctgggcgacagagcgagactccgtctcaaaaaaaaaaaaaaaaaaaaaaaaaggtagtgtactttttcttctgtcctaggacagtgggtggagtaaatgcagtgtaattccaaaatagaggtaacaggctactagaagggttcttactcattttgtgccatgggcccctctgaaagttggtgaatttatggggacctttttagaatcatatttttagatgtaaaacacaaaagacataggattataaaggaaaccaatcatattaaaatgtacttataaaattgtttttaaaaattatgacacattccagagacataaacacatatgttcacacaaaaacctgtgcatggatgttcatagttttattcatagtagacaaaaactggaaacagcctaaatgttctttaacgggtgagtggttaaataagctgtattatccatactatgggatactgtatggcaataaacaggtataaactattgatatacacaataacttgtgtgccttcccagggcattatggtgaatggaagaagtccatgtgccaaaaagttacatatagtatgatttcatgtaaatgacattcctttttttatgggtacatagtaggtgtatatacttaaggggtacgtgagatgttttgatacaggcatacaatgcataataatcacatcagggtaaatggtacaatctttaattgtacaataaattattgttgactatagtcaccctgttgtgctatcaaatgccagatcttacccattctgttaaactatacttttgtacccattaactatccccatttcccctccccacccacttcccagcctctggcaagtatcattctactctcttatctccatgagttcaattgttttaaatttttgctcccacaaatgagaacatgagatgtttgtctttctttgcctggcttatttcacttaacctaatgtccttcagttctatccacgttgttgcaaatgacaggatctcattcttttttatggcggaatagtacaccattgtgtatatgtgccacattttctttttcttttttttttttttttgagatggagtcttgctctgtcactcaggctggagtgcagtggtgtgatctcggctcactgcaacctccacctccctgattaaagcaattcccctgcctcagcctcccgagtatctgggattacaggtgcacgccaccacgcccggctaatttttttgtatttttagtagaggcggggtttaaccacgttggccagactggtcttgagctcctgacctcaggcaatccacctgcctcggcctcccaaagtgctgggattacaagcatgagccaccacgcctggcccctgtgccacattttctttatccatttgtctgtagatggatacttaggttgcttccaaatcttggctattgtgaatactgctgcaataaatatgggagtgcagatatctctttgatatactgattctttctttttggcatatacccagcagtgggaatgctggaccaaatggtagctcaattgttagttttttgaggaagctccatactgttttccatagtggctatactagtttacattcccaccaacagtttatgagggttcccttttctccacatcctcgccagcatttgtcattgcctttcttttggatggatacaagccattttaactggggtgagatgatacctcattgtagttttgatttgcttttctccaacaatgcatgatgttgagcaccttttcatatacctgtttgtcctttgtatgtcttcttttgagacacgtctactgagatcttttgtccatttaaaaaaatcagattattagtttttttcctgttgagttgcttgagctccttaaatattttggttattaatctcttgtcagatgtatgtatagtttgcagatatgttttcctattctgttgtctctttgttgattgtttgctttgcagaagcttttgaacttgatgtgattccatttgtaaatgatacttttgaaaaaaaatgatagaagtggagaataggttagtggttgctggggtggagggttgtgggaaggagatgggtgtggttattgaaaggccaacttgggggatccttgtggtgatggaactgttccatatcttgattgtggtgttggtatacctgaatttacacatgataaaactgcatagaaatgcgtatatatatacacacacacacacacacacacacacacacacatataaaaatatatatacacatgtatatatacacacacacatatataacacacaaataagtacaaataaaactagggaaatttgaataagatagatgggttttatcaatgtcaatatcccagttgtgatatcataatatagattaccaggatgttaccattgggggaaaagggatctctgggcattatttcttagaactgcatgcatatttccaatatctaaaaatagtttgattaaaaaattgagacacagtaattgtagttctttacaatatttgttaaataacaagataaagtggcaggttgtataactcaagtaattttgaagaagtgataagcataaatgatagttaaggtattttcacaagtgcactatgtgtggtataacaggaaaataaatgtgacttggtgaccaagttgcaggggctgctaataccactgtaatctgtttcctatattcatagttgaaagaagtactagatttaagtaagaggttactgaaaatatgttttcctttccaaattcacataccccctaaatttagaccccaggataagaacccctgactttatatctttttacatttcattatctgttatatctcaaaggcctctgtcaaataaaagagaaacataatgtgtatttgttttgcctcaaataccatggataatgatgggggctcatagaaaatactagtggacacacttcacagttttaatgatttacttgctattactcacccatatgcccattgttcaccaaaattgcttaacactagttttaaaagagaagtatatgtggattttaagtatagaataaactacacattattgatatgaaaaagaaatatgtcaaattgattgcttattatccagattgactaatattgactatcattaaatattttaatttgctttcgctaggaaatcagttaatgatggtttagccttcaattgtccgtatctctgagagtatctagatcaaatgaggctattgttttataagaaaggaaggttagtgttttgggattaatgttctactttaaaatatcacctttttgtttcctctaatgttaaaatctaaaattttttgaatatttgagtaattatttgaaattattatgaagtatttcctctatactctattggttaaatatgtctttcataacataagaagtaacaatatggacacagaattaaaaactatgtttagagtttgtgtacttgacatttctaatacaggctgagcatctctaatccaaaatcgaaaatgctccaaaatccaaaacttcttgagaaccaacatgatgccacaaatggaatattccacacctgacctcatgtgttgagtcacagataaaatgtggccaaaactttgtttcatgcacaaaattattaaaatcattgtataaaattatcttcaggctatttgtatgagttgcatatgcaacataaataaataacatgtttcaacttgagtcttgtccccaaaatatctcattatgtatttgtaaagattacaaaattggagaaaatcagaactctgaaacacttctggtcccaagcattttgaataagggatactcaatctgtaatacaagtgctcaaaaaatcatctaaatatttgttctgtgatggtctaagagtctgtaatttgggagtgaaatgcttaattgatatttagtagacagaagcttcaataagggaacaataaatgatttcatcatatacaaccttatacttttctttcattaaacattttagctaatcatattttagtaaacttatttaaatttttttgggaaaaatggcacatataatctgaagaattatgatgcttatacattgctgtagaaaagcttttatcacccctgccctataatttgcggtatattctcttgttttgcctattattttcatcctctgaaaatgccttagttagaaacagtgtttcctgcaatgggaaatgacacaatatgaagttaacctgatgacagtaattttctgtgtaggtttttttcttatagacttcaattgataatatgtagtatcttttaccctacatttttttgtgtggttaaaaaaaataaattaaaaaaagacttaaaggttagacctaaaaccataaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcaccgcaaaagaaactaccatcagagtgaacaggcaacctacagaatgggagaaaatttttgcaatctgctcatctgacaaagggctaatatccagaatctacaaagaactcaaacaaatttacaagaaaaaaacaactccatcaacaagtgggcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactggttcaaccactgtggaagacagtgtggtgattcctcagggatctagaactagaaataccatttgacccagccatcccattactgggtatatacccaaaggattataaatcatgctactataaagacacatgcacatgtatgtttattgtggcactattcacaatagcaaagacctggaaccaacccacatgtccaacaatcatagactggattaaggaaatgtggcacatatacacaatggaatactatgcagccataaaaaatgatgagttcatgtcctttgtagggacatggatgaagctggaagccatcattctcagcaaactatggcaagaacaaaaaaccaaacatcgcatgttctcactcataggtgggaattgaacaatgagaacacatggacacaggaagggcaacatcacacaccggggcctgttgtggggtttggggaggggggagggatagcattaggagatatatctaatataaatgatgggttaatgggtgcagcacaccaacatggcacatgtatacatatgtaacaaacctgcacgttatgtacatttaccctagaacttaaagtataataataaaaaaatttttcaatgcaaattgcatattaaattattttaagttttattataaattgattttaatatattttttatattttttgatacataaattacataactgtattactctcccagtaagagatggctttcttacataaatggagagaagccatctaaaggttctgcactatatagcattctctgttcaaaccaaatataccgctatcagaataaataaatagattcacttggatagggcacttattttgtgtttccctttcctccttgaactcaaggaactgatggtgatgaaaatggcattttgatttcttatgtttgaaagttataggagcctctccaagaacaacagtatgaacctttgtagatataatcccaaatatgttaatctatagcattatattttcagagaacatgatgatagattagaaacttatttgattaaaatagccaaagaaatggacttcattagggtttgtaaatcatggtcaataacactaacaaaattactgttttcatgaaaatattgcccatcctatttgaagatgacatccctgatactaattgctatctatgtgcatgctgtatagctgaaaagacctgtgtacaatcaatagttctgtctagtgtctgcagcaagatacctttacagctaagaaccataaagccttttcccaagttgtaagtaagtctgtttttacattaaaaaatgacagaccatgctcagactaagtccatctaaactcagaagtgattatctccactgcaaactagaagtgttctttcttagaatattgcttctctgctgttgattttaacatttcatatcagagcaaggggaatctgtgactattaaactggcccaaactaccttttgattatttgtgtactgtcttaaaataatacaagcccagtcacattgactagtatctccatcctaatgattttcaaattaaggaatggcttcaaattaggaaagctctttgttcacctaggtttggaatagcatgatgtatgctaattgctaactttgtctgcattattttttaaagatcaaatgggcacagtggtaattttcattaatctcatacagagcagctaattaaaatttccattattacccatccattatctagttgtttcctttgttcagtatcagaacaggatgttaataagccattcttgtcttacagccctattaagtattatgagaattaatgtattgcactattttgtttttaggtgattttaaaaatattttcttgcaccatattgattatactgaaggtactttgacaccttgacattttgtaatagagatttcagaattaaatacttgttgctttaacgttttattcaatattgagcaaaagtagtatatagtagagacaggagctatccaaggaccagaatatttgttttagtctcatactcttactgattatgtgaacttaggcaattacttggattcctcatttttgtaatgaggatattagaagaactgatctttaagggccagtccagccttagcttgctatcatattttcataattttcaaatatgaacttatgttaaaatctcaaagtccttctaagcttggtaaaaagcatctgttctataaagttatatattctctgtcatgctctagtagattgtttgcttccattccttataaccagagaggatcctaaattttataatttaagcttgtttctaagacttgggtggggagtgagccacaaagtgatgggctggctcacttgtccacaaggagtacctcggccataaccatatgtcccaattagactaatcctgtagggaatcaattagaaaaagggaaccaacattttctcagtagattattctgtgtccatgagatgcccaatataaaatacctctgagctgtcctcagcataccatacagtgtctcagtttacctgttctatattcagcatctctgaatatattacaactgaaagtctcagaactataatattctgaagcaaaactaagcttagaatcttcagcatgttgaaactcatcactcatctacccttttgtttattctctatccatccatccacccaaccatccatccattcattcattcaggaaatatgtattgaatgcttacttaagcactgtcttaagatctgaggatatagtggtgaacaaggcaggcaagaatcctgtcataagagcttatgttttagcgcagaagacagtaaacaactaaattacaaaaataaattttcatagaggtaatactgtaaatgatatttaaaatggtgttgcgatgataactagaatgtggggtggggagaagactatggagctgagattaaaatgatgggagccagcaatggagaggttgggataagggtcttcaaggcagagaaaactgcaaaatacaaaggtcacgcaacagggttaaattccatatacaatcctctaggggaagattagtggtgcctttttatatattaatttagaaataactttgaggattatatgaaagcggtatgtgactacagacttgaaaattttaattcgttttactagtagttttcagactggcacatgtagtaaatagatcccttgttactgatgaactttgtgttgttgtagaaagtgagttggccgagcaaaaataaaactataattttgaatttgcaaaattatgctttaaatatttacttgctattattccttgtgaaataatagatggataaggaagttacaggaatatggacatgatctctcggtgatggttttacttactgtgccatttaggtgatgatgattcatccagtatacttttttatttgtggaggagacggagtcttgctctgtggctcaggctggagtgctgtggcgggatctcagctcactgcaacctccacctcccgggttcaagctattctcgtgtcttagcctcacgagttgctgggattacaggcatgtgcctccatgccagctaatttttgtatttttagtagagatggagtttcaccacattggccaggctgatttcgaacccctgacctcaagtgttccacccgcctcagcctcccaaagtgctgggattccaggcatgagccaccgtccccggcccatccagtatatttttaacgtctactgtgtctcataacgaagcaagaaataccaagtcagtggccattatacaaaatatgggagctcaaagtatgaaatcgtattccttgttctgcagttattatggagaagttcaataataacacacttttattgaagctcactaaattcatgaccggtgttagttatgtggcatagatggagttcccaatgtagaagtgagacagacacaaataatgacctctaccacaatattttaagtgctataataattataatattgccacagcgctaagggaatagagttcccctatatgttataagcctttatcagactttaaaaatttagcatctaatgggatttttgaaattcagaaattaagaatgattaacactttctacattgaggaggcattctcaataaaaacccaaatagtgtgaaatcatagggaactcatttctcattattaacatttttttaaatgtcatatcctctaatgataatacctctacccaatggggaaaaattcctttccttatgatctccttataatattatatttcctatgatagtatatccttatgatgttattttatagtaagtatccttagatgcttagcagaaactgagtgtaatttttatgaacctgtaaaatgggactcaagcttggagtcttaattcagggatatacatttacagtataggaaaggggcaattatgattaggtacgtctagaatgtgaaactatcagttgttagtatagtgaatgtgttgacaatattttcctcccagccttttccctgaactacttatatagttatagcaagatgatgaagttaaggagctgtgatgagatgagttctagaaacaactccatctatattgaaagttaagttaaaaactagtcactatcagataaatgtatttaatgactttttaagattaatctacaacctgagagtaccagaaaggaataattgggaactggtgaatgctttcaactgatttgattaattaacatgctaattggagactatattgttttacattttaataactgttttcacttattttttttagaaaggctgatactctgatatctttcaatagatttgggttatgtataatggtatatattaaattttatttgctggattttgtggaattgaatatacatatcttaactaggaaaattaataagatgatttttgaatgcttatcctctgggttaaggaggactagctaatattaattctaatgcctgaattgtaaatttaagcacccctgtcaatgacactttatgtaattcaagttcatattctattcaggtcatgagcaccagcactgtaattttttttttaaatgaggttgaggaaaatgttgagatatatacaacacaattttactatatcaattctgtgatcaagaatttttaagtgtgtagcactctgcacacatttttatataacaaaataaatattctatgcattattttacttaaattttttttgaaacattgtctaaaatggtctctttgtttattttatagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcaggtaagtcgttcttatcatttcggtatgattcatacaatttgtagtgcatataattgtttgggaatataataagttttgttatttaaacctcaagatttcctgactaaaaatctgatgttaataaaacagcagcatctgattgtgaagtcgtaaacttttaaaaatatatttagttagttggatctctagtaatgtacaattttaagaatacaaatgttaacatagagccagaagttaaatatccacatttacatggaaatctatttgtgggatcagataattattatatatttatttataaagcaaattaagtatatttgctccatgattttattcttttttttttttgtgagacagagtcttgctctgttgcccaggctggagtgcagtggcacgatcttggctcactgcaacctctgcctcccaggttcaagcaattcttctacctcagcctcctgagtagctgggactacaggcacgcaccatcatgcctggctgatgtttgtatttttagtagggaaggggtttcaccatattggccaggctggtctcgaactcttgatctcgtgatccacctgccttggtcttctaaagtgctgggattacaggtgtgagccaccgcgcccggccgattttattcttttaaaacttgaaaggtatatataactttatgttcttctataagttttagatatactcttcacatatttctgtaattttgagatagcaaaaagtgaattattttaaccagtaaaagaagtgagagcattaataaacttctcaaaactctactaatttaggctattaactaactacaaaggattgttattaggttacttgccaatggtggattccagtaactgtggttcctttattaagcctttaaatcaataacacccaaaataaaatgttttataaagaaaaataaaatttcaataaaatatcaaaacattcttggccgggcgtgggggctcacacctataatccctgcacttcagggggctgaggcaagtggatcgcttgagtccaggagttcgagaccagcctggccaacatggtgaaaccccgtctctaccaaaaatacaaaaaagtcagccaggtgtggtgatgtgcgcctgtggtcccaggtattcacgaggctgaggtgggaggatcacctcagcccgggaggtggaggttgcagtgagcccatatcccgccactgcactccaacctgggagacagagcgagaccctgtctccaaaaaaaaaaaaaaaaaaaaaaaacaaaaaaacaaaaatccgggatctatttatgtaactactagaatcttaagttcagaatttactccataagagtatataaaaaacttactgtgattttatccatgtttttcctaatatataataggtctaagtcttgtacttttctgtcctgtccacagagccttgaaaataatttagagctcagtcattcagtttggatttatgtataaattgaaatatattaattacttatttatagtgcacttggcaaaatgcccagaaaattacaattttaaaacaacaaaaaattttttaaaagccagtgttaagatgtgacttatcttagagtatgataatcgttgaaagacgattgtcttgccatttcttccaaaatgctcctaggttttttgttttttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgtgtcagtggccattagaaaaaccactaattcttgcctaagctttgtgatgcatatttttcttccccttgaaagtaaagaaattgtaaatggcactcttgaaaagcacagatgaataacatactataaacctgttacttaaattatcagacattttgaaaattctggtcttcataaacctaaaatattcggaaccactttttgttgaaaaaggttacctgtcctagggaaaatcatactgggggagaggcaacaaggggcatatatacttggaattgtggagctgaaagagtctagcagatacaatattcttttgtgacattaaaatctgatatttatgagtataattataggtcactcccataattgcttgagctgattcagctggccagtggatgcgtagccacttgtttttcctatactaggagcatgcggagggggaaaaaaactcttttttttttgtttgggaggccaaactgcttttgtccctgcaaactgatacactgagatatgtacacctgaatttaaggcagaagaccaacctctctcccatcctgtgaggggaaatgtcctctatctgtgttcgttggggtttttttaggcttttaaaattactcctcccaacgcttattcttctgaatggaatcgtgtgctttagtggattctgctgcaggtaagagatagcagtggaaaaatagtaagtaggtctagatataatgtcagtggaaataaaacacttttaggcagaaaatcactggattgttttatacatgtatatttagtccatgttaaaggtagcagatttttaaagttcattttgaacacccacctggcatgcatactttttcaattttgtttagactgggaatgacttggctaatatcccctttctccaaggtcctgccctgatagttagccacaccttttgaggataagatacaaatcctggggacatactattgactattttgggcagggacatttaagcctgaggaacctgaaaaacataattgatgattataatccacccaaggttttttcctatggctcacaggcttacgaaatgtatgtatttatattgaggttgattctaaattaactatgaataaatatatttgaaagtgttttcaaggccaatataataatcttactatggtcataattattagtgatcattttgttacttttacctactaaatttagtaatatttggagtagaagctgaaaaacataagttcttatattttttcaatttctgtttactttttataacagcaatttaaaaaatgtaactagcaagaattatgtttgttcctgaaacctttattgagttcctactatatgcatttaagtgttaactttaattttgataagcttaaattttattgacttctgaaatgcttattaaagatagtaatagttaacattttaacatttatttagtatttattatctcccaagtactgttctaagagtaggagttgtgtgtatgtgttgtgcgtgtgtgtatgtgtgtgtgtgtatgtgtgtgtgtgtatgtgtatgtatgatccctgtgatgcgtagatttacgttttcagctcagacctctctgtttctctctctctttttttttttgagacagagtcttgctcttgtggcccaggctggagtgcaatgtcacaatctcggctcactgcaacctctgcctcccaggttcaagtgattctcctgcctcagcctcctgactagctgggattacaggtgcccgccaccatgcctggctaatttttatatttttagtaaagacggggtttcgccatgttggccaggctggtctcaaactcctgacctcgtgatccgcctgcctcggcctcccagagtgctgggattacaagtgtgagccacccacctggccagacctctcttttgaaattgagactccatctccaaatgtcttattggatgacatataggcatttttaatacattaaaaaataatgaaaaattatgtgtgatatgtgttttttatatatatatataacacagatatatatctctatatatgtacacacagatacatatatctatatatatacatacagatatatatatctatatatatacacagatatatatatctatatatatacagatatatatatctatatatatctatatatatacacagatatatatatctatatatatattaccatgtatatacagatatatatatatctgtgtatatattagtatgtatatggcatttactacccctgtgcaatgttttaagacctttaaatgtacatatacaatcaggataacagtattgttcgtattttgtagatgaacttgaggctcagagaggttaagtaatttgcgccatattaaagttgcatgcccagcaagtgtcagtgttaagatttaaacccaggctttgtatctctcgagagcctaggcctttaacaactggtttgtacagtgtcacaataaggaaagtctattaaaatagtattctttcactgttgttagtattctttcactgtcatcacatactgaatattttgactttctttcattaatatttgtctgatttaaatgaaaaagaaactatgaaaactttcagcaaatgtgtagaagataatataaaaacacctttgtactcatctatcagcttaagagacaaaacattattttttgctgtggtagagaacttagttgaataacttgggagtttttttatgatatcgtaataccatttgggcctatattttcattgatttaaaagatcgtctgaaattctacattttctctaaatctatgcatgtagtttttgcaatataatatcttaagaatatatatcagtgtattgaaaagcctatttttttttctgatcacatagctgtgtgtaaattgggacttctttgccctatccattgtggatgatacttctagtaattctaacaccatctctatgatatttattccaatttgccatcatgtgataaattacgaaaacaattttttaacattaagagttaatttcctttggtaataccttaaattggagaagttcaataaatagcacttaatattatgtggtttgtttttacatatcacatggataatcctacaaaggaataacaaaactaaattccccttgtccatatggggcttatatatatggagcttacattccagtacaggaattcagacaatttttttaaaggtgtacatcaaatatcaggttgtaatatgagctgaggaggagatgttgctattttatattagatgatcagtgaaagcctccctgactttaatgacatttgcacagaggtctaaaggaagtatggcagtgacctatgttcactggaggagtaatgttgttagaaacggaaaacagcaacagcaaataccaaagatgggagcatgcttggcatgttctaggaatgtcaaggaggctagcatgctggaagcagataatgtagagccttattgaccattcaaaggactttggcttttactttgagtgagctgggacactgttagagagttttgaggaatggaatggcatgagatgacctacatttttaaaggatagccctgggtggaagcagggagaacatgttgtacattactcaggcagaaggtgccactggccacagaggtttctagctggtgaagtgacaccccaggatcctgtgacaatatgataaatcattctagttcttgatcactcctctgtggtgaccttggtccagtcaatggacctctttggtcctcagtttcttgatatgtaaatgggattggagccttccagctctaagcctctgtgttctgtattttcttttgcttagttttaatcctcttacctttgctattggaactagattagtgtttaggtattattttgaagagtgagaagaatgttcctctataaggctagaggatttcctaatgtttcattattttttgtatttataaatgtatttaaccacccccagacagatatttataatttcctttaaatacggatgaaagcagttcctaaaactctgttgcataactgtttttgaaacctggtgttcattagaacccacaccgttgtcctctcgtgggtaattctcctccctaccacagttttaattggtttctttttgttcagcccctcgtaaaatttaaaaatatatataaataagtgtacacacacacacatacgtatacatactaacagttttaccaaacatcctcaaaacagtcattttggaatattaagtggggtcatgaatttcaaattcacatggtatttaatcactcaggtgataaaggctctaagaaagtcattttggtatattattttctgctaaagcaaatacttaaaaatcccttttataagccctcattaactggtcctatctcagatcactctgttactgtacatttccctcaacatttattttttactatatacatttacctgtgtctgtttatactctgtaatagtttcatgcatgcatgtctgtttttctcatttagattttagtctcctctggggaagggaccctcttaccctcttatttgtctcgtggtggctggtactgtgtaatttatatatactaatgtgtgatttgatgtagttattgacccaccatcaataaaaacctatgcttctccaccagtgggaatgaatttgcattaatcggcactattttgtggccatgcatttttagctgtaatcagaaaaagaatgaagctaacttcttccacataagaatgaaaccttggtttgaatcatattcacaatccacagacaacatagcatgctttacacaatagccttgttacagttgcatggtgaattaatgaaattgaatgtttacaactctatttaacactctaaaaatccatgtgctttgaccgtaaagtaaatcccaatctgccatcacaaattgcattagactttgcacataccatggtctatgtgtgatttagaatgaggactctgttatttagagatttttgttcatatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaagaagcagatattctacttccgtaagacaaaggtaaaaatgccaagctccaattaaatgaggaaaggaggtggaacttttccaaaaacttaggacaatgtcaggtaatgatttgagtataatgtagatccaagtttctttgtgtggagtggagaggggtcggggggtgtttatcaggtaaacagttctgtctctcagtaaaagtctctcaataaaaagagagacatagctgttacctgataaacgacattgcatctcttttgtgttgttgtttgtttgtttttcaggagggtcattcttcctaattctgaactcattttattttgtggttctttaaatgagggatattggacaacaacagtagaatgagtccttgatagttttccataaagtacagaagatttctatgaatgtccatttcctgcatttagccaaaaagtaaaaaaatcaaggttatgatatttctacaatgaccaggaataatagtactggaatgcagctttctagtaatctaacctgctaccaaggtgtacttgagaaatgcccctgaggctctccccttggactgtctatcatctcagctggacttttgatagaagttggatagctgacaactcacaattaagatgccagctggcacctggagtgcaagtagtctgtatagttgattgaaagaagatccatgtgcactagataacagtatttgctctatgaccccagctgttcgactggtggtagataatggacagctaatttggggagatttgccacctggtcagcaaagctgtaagtgtatagcctctcacaccaggcagtttaaacctggaatcttctgttaagatggaatccatgaaggcagaatatagaagataacataatgttatagtacttctaaaaactaaaacatcttcaaatgagacagttttggtgacctcttatatgaatatgaatttcaagcctttcatatacccgaaatcaacctactcctgttaggtcagttctgcagcatccagtgttattgaacatatgcagattgactctatttctattttggaggatattgcctgagtactgagtactgctacagtttttttttttttcttttatgtggtaccatacttcccttgataccagcttccaaaagaatttcctggagatcatatcttaaattggtacgttcaacatttattcatcaaaaactattgaagattggagtgctgtagttaaacacatttttaaaaattgagttataaatttccatatgtgaattaatatctgtcaaagaatatcttgaagtggatacagcactaaaactatattaagtattaatgaatttttcttcgatatagagaatgcttaagaattttatagtgcctttgaggttcgcattatgagcatttattaagatggtataatactttaagtgtaagtggtgtgggacatcaagctgggggtattctctgaccttgtgatatgctttggatcttcaaaaacttttctgtcagtttatgtgcttgatgagcaatgatgttgctttctcctgggaaggagatgggttattatgtgggtttatcattaattttggtttctgttaccatttttgtattgtttgcaaattataatgatttatctgttgaaatcatgtgtcttaatttgctgatgaccatagtttgattcaagtattcaccttattgcatttcacaatgtgcttagaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaacttattttatttcacaaccagaaaagctactcttattggtgtgagttctttcatggaggtttgtttgtaaatgaagaaaaatccatgtttttaattaaaattatttgtttgttttggcttttaactgttccaattaaaaagagagtctttgttattttgaataaggccaaagttatttcagcaattaagacgtgctttctttacaaagcatttatatgtttgaaaagctttagcaaggataaatgcatatcttttaggtgtagctatatttctagagttttctgaaaataggtacaagtcaggttgacaataacagaaggctgatatctcttagggactttatactgcatttagtcctacaaatgctttgtttgtatgtcatgtatatatttgttatttttgtgttgttattgctttagatggtttatttcactataatataagaaaaataatagcagatttggcttattttgtcttggataaaagccttaacaagttgtttagtgggggattattaaggattttgaatattcgttgtatttatgttggtcaaaggatacaaaatttcatttaaacagaaggtgtaagttcaagagattcatcgtacatcatggcgactgtagttaataccaatatattgtatacttgaaaattgctaagagaagaaatttttaaaagattatttttaaaatttcaatagttttgggggtacaggtggcttttggttacatggatgagttctatagtgttgaattctgagattttagtgcagacatcacccaagcagtgtacattcattgtacccaatatgtagtcttttatctctcacccacctcccaacatccgcccacttactttgagtaatgatggtattttgatggaagttgcaatgaatttatagatagcttttttttttcaaacaggtcttagtttattccaagttttacaaagtcaaagttgcataagtcttacaaagtcaaagttgcataagtcttacaaaattaaagttgcaaagtgaatagtgaagcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaaccagtttacagtcccaccaacagtgtaaaagtgttcctatttctccacatcctctccagcacctgttgtttcctgactttttaatgattgccattctaactggtgtgagatggtatctcattgtggttttgattttcgtttctctgatggccagtgatggtgagcatttattcatgtgtcttttggctgcataaatgtcttcttttgagaagtgtctgttcatgtccttcgcccactttttgatggggttgtttgttttttttcttgtaaatttgtttgagttcattgtagattctggatattagccctttgtcagacgagtaggttgcgaaaattttctcccattttgtaggttgcctgttcactctgatggtagttcttttgctgtgcagaagctctttagtttaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttccgagggctctgttctgttccgttgatctatatctctgttttggtaccagtaccatgctcttttggttactgtaggcttgtagtatagtttgaagtcaggtagcgtgatgcctccagctttgttcttttggcttaggattgacttggcgatgtgggctcttttttggttccatatgaactttaaagtagttttttccaatcctgtgaagaaagtcattggtagcttgatggggatggcattgaatctgtaaattaccttgggcagtatggccattttcacgatactgattcttcctacccatgagcatggaatgttcttccatttgtttgtatcctcttttatttcattgagcagtggtttgtagttctccttgaagaggtccttcacatcccttgtaagttggattcctaggtattttcttctctttgaggcaattgtgaatgggagttcactcatgatttggctctctgttcgtctgtttttggtgtataagaatgcttgtgatttttgtacattgattttgtatcctgagactttgctgaagttgcttatcagcttaaggagattttgggctgagacaatggggttttctagatgtacaatcatgtcgtctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagataagtcccatcagtacctaatttattgagagtttttagcatgaagtgttgttgaattttgtcaaaggccttttctgcatctattgagataatcgtggtttttgtctttggttctgtttatatgctcgattacatttattgacttgcgtatattgaaccagcctgtttggcagcatggtcattttcacaatattggttctacccttccatgagcatgggatgtggttccatgtgtttgtgttatctgtgatttctttcagcagtgtttcgtagttttccttatagagatattttgcctccttggttaagtatattcctgagtgcttttttgtttgtttatttgttttcgttttgcagctgttgtaaagagggtcgagttcttcatttgactgtctgcttggtgccactgatttgtgtacattgattttgtaacctgagactttactgaattcatttatcagatctaggagccttttggatgagtctttagggttttcttggtatgcaatcatatcatcagcaaacagtaacagtttgatttcctcttttccaatttggatgctctttatttctttctcttgcctgattgctctggctggggcttccagtactatgttaaatagaaatggtgaaagtaggcatccttgtcttgttgctttcaacttttacccattcagtatgatgttggctttgggttggtcatatatggcttttattactttgagggaagtcccttctgtgcctcggttcttgaggatttttatcataaagggatggtggattttatcaaatgctctttctgcatctattgagatgatgatatggtttttgtttttaattctgtttatgtgatttatcacatctattgacttgcttatgctaaactattcttgctaaactattcatccctgggatgaaacccacttgattccgatatattatgtttttgatatgctgttggattcagttagctagtattttgttggggatttttgcatcaatgttcaccagggatattggtctgcagttttcttttttgttacgtcctttcctagttttggtattacggtgatactggcttcatagaaggattcagagaggattccctctttctcttttggaatagtttcagaaggattggtaaaaaatttttctttgaatgtctggtagaattcagttgtgagtccatctggtcctggagtttttcttgttgacaatttttttttattactgattctatttccttgcttgttactggtctgttcagagtttgtgtttattcctgatttaatctaggagggctgtatgtttccaggaatttatccatttcctctagattttctagttttcgtgtgtaaaggtcttcatagtagtcttgaatgatcttttgtatttctgtggtatcagttataatgtctccagtttcatttctaattgaggttatttgcatcttctctcttctttctttaattaatctcgctaatagtctatcaattttatcttttcaaagaaccagctttttgtttttttaatcttttgtatttttttttgttgtttgaatttcatttagttctgctctgatctttgctatttcttttcttcttctagctttttggattttgtttgttcttttctttctgtttttttttttttttttttttttttttgagacaagggcacccaggctggagtacagtggttcaatctcggctcagtgctgcaacctccacctcccaggttcaagcgattctagtgcctcagcctcccaagtagctgggactacaggcatgcaccaccatgcccaactaatttttgtatttttagtagagacagggtttcaccatgttggccaggctggtctcgaactcctggcctcaagtgatctgcccgccttggcctccgaaagttctgggattacaggtgtgagctactgcgcccggcctttgtttgttcttgtttctctagttacttgaggtgtgacattaggttgtcaatttgtgctctttcagactttttgatatagacatttagcactgtaaactttcctcttagcactgcttttgccatataacagaggttttgataacgtgtgtcactagtaccattcttttcaaataagttttaaatttccatcttagtttcattgttaacccaaaaatcattcaaaaccagactaatttccatgtatttgcatagctttgagggttccttttgcagttgatttccagttttattccattgtgttctgagaagatgcttgatctgattttgagtttcttaaatttattgaaacttgttttgtggtctatcagatggtctgtcttggagaatattccatgtgctgatgcgaagaatgtatattatgcagttgttgggaagaatgttctgtagatttctgttaagtacatttgttctaggatacagtttatgtctattgtttctttgttgactttctgtcttgatggtctgtctcgtgctgtcagtggaatattgaactctcccactcactatgttgctgtctatttcatttcttaggtctagtagtaattgttttataaatctgggagctccagtgttaggtgcatataaatgcaggattgtagtatcttcttgttggtcctgagagaggagatttttaagtgttctcataacaaataaaatcaagtatgtgaggtaattcctgcgttaattactttgatttacccatttcacagtgtatgcatgtgtcaaaacatcatgttgtacagtataaatatataccgtttttatttgtcaataaaaataaatataaatttaaaaaaacacatatttaaccatggttaagaatgtatgtatgtgcacactgaagaacatataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgtttatgatgtttatttagccgaacaaattttccttttaagatgcggaaaatactaaggtttacttggttactgtttatgcagatttgatccatggactgaatatgtgatactgtttatgttgggctacatactggttttaatcacatggaactctttctttccttaagtgtatgcaactaaaatttggttttagttgcattaaaaaacattacagtagcaatattggtgtttaagtgagatgttttcctattttaaaaaaaacaaaccaaaacccaccactcaagataacatttaaagtctcctcaaccttttgaattagttgtttcacatgttataattttaccaaatttctgaattcccccaagaaaccctgaactatcattcattttatttgatgttccagtgattcaggttgtagtttgagattacacatgggaatagaacaccattagagggaaataaaatcctttgtacagaacacataaccctctatactagcctttagcactgcacaaacagtgataaagggatgacatgactaatattggactccttcacatgagaccaattgcctttacagcttatgggattcagtatagaagtttctaattttagctttaactcttttgaaagagatgttaatttggataatctaatcattgatggacatgcagtcactattttctattatatcttcattgtatatagcatactgaactcatctgttcattacatctttggttttacattatatttaagtgaaatgtaactaaataattcagagtctgaatctcaaatttatgggagaaaggttgaggttttgggaaactgtgaaatgttgtcctttataagaatctatgagggagcacagtcttattccctccttcaataggtacatttatagaaaattttcctcgttttgctttgccctgaagagctagagaggggagaatcttgctttctcttagatttagggttaattgaatcttctgataccttcattaaatgtaagattttctttcctttgatcatgctgatcagtataagtgggtcctttaaaaataatgaccttagaagttctaaaggcttgagataggtttctgttttaaaacttcaatatatttttgatataattctgtcaggattatacatgaactaaaaattctctccccctcaccattataatttccatatctattctgatgtgaattggccagcactaaatacaattagaattaagtatacacaaaattggatagtgaccagttaaaacacatgaggttggctgggcgcggtggctcacgcctgtaatcccagcgctttgggaggccgaagcaggcggatcatgaggtcaggagatcgagaccatcctggctaacacgatgaaaccccatctccactaaaaatacaaaaaattagccgggtgtggcggcaggcgcctgtagtcccagctactcgggaggctgaggcaggagaatggggtgaacccgggaggcggagcttgcagtcagccgagatggtgccactgcactccagcctgggaggcagcgagactccgtctcaaaaaacaaaaaaaagaggtaatatgagtaccaaatatttaaattataaagtctggcctcaaactcttgggctcaaatgatgcccctgtttcagcctcccgaatagctgagatgacaggcatgacactgtgccccagtcttatttttaaacaagtcaatagagtaagtttagtataattttagtcatctgcatgttttgtaaaaattaatataattttcattaagtgattaaaagttgtgttaatactgtggaaaaggattctttaatttatgcctaaaattcatactgcattttggactagaagattcaaacaacattcagatttttggtttttaacattttccaaaaatttcttaatggctttattgtgatgttttatatacattatttcatttaatagtcacaaagacttcatggggtataggtagtattctcatccctattttgaaaatgcaaaaacaagcttagaaaatttacgtatattatcaaaagtaacacaactagaatatgtagagatgagattagaacctagatctgttttcctctaaagcttatgcatttagccatgcagctatgtggccccacagcataatccaatgatggatgatggaatattttctttatttttgggtgaacttggaaaaaagtctttaatttttagctttttgagcagcgtaacagatattagcctccctgatagatacagccaaaccttttttacatagggttggaagatgctgtctcactgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagataaacaaattgtggtatattcatacagtaacaaggaatggaatactaatacatgcaacgaaatggttgaatatcatagtattcatgctaagtaaaagaagccaaacacaaaatttgaaaactgtacaattcttttataattatattctggcaagcacaaaactatagggacccaaatcagataagtagttgccaggatgctgggagtagggaaaagggattgactgcaaaggggaataagggaatattttagggtgatgaaaacgttttatatcttatttgtattggtggttacatgactatacatttgttaaaatgataaattttactatatataaatcatacctcagtaaaaaggaaagaaaaaataactcatgtttgggttggttatgaaaattattaagagtaattttcctccgtttttccttctgtttggttcttcattattctctgcctgttctatgtccctcataaatgtaaggtccatgagaaatgtcagtttcttatttcagggctgagatagtacagaaaaatttatgtctttgtctgtaatctctgagtaagattttaaatcaggtcatcaactgtattcttatcattctagatgttccagttagtactaaataattcagagctggaatttgcatactccatgaaatataccaaatatatctgtttcaactggattccttttttttgtttgtttgttttttttgagaccgagtcttgctctgtggcccaggctggagtgcagtggcgcgatttcagctcactgcaacctccgtctcctgggttcacgccattctcctgcctcagcctctccaagcagctgggactacaggcgcccgccaccacgcccagctaatttttggtatttttagtagagtcagggtttcaccgtgttagccaggatggtctcgatctcctgacctcgtgatccgcccgcctcggcctcccaaagtgctgggattacaggcgtgagccaccgctcccggccctcaactggattcctgatctgtgttctgcggcactgggagggcacagtatggttgggagggcatgtaaagcagccttgagttctgagcctgagtcttgcctgagaaaggcttcccctgcttctcagcaatccattgttccctgccagtggttctcaaacttgagcaagcatcagattcaccaggagaattagttaaaacatacacttctatcttcctcccagctactgattcagtaggtctgaggtagggcacaagcattttgatttctaacaagttcccagatgatgtcaatgctgctgatttggagtgcacactttgagaacccttgatttatgcttacttctagtgtttcaatgtcagaatttctgcccacatgctcacatacaggagccaacattttgtttttaaactgcctcctcatttcatgaccacttttgtattggctgaaatcagtatactctatgtatatgagaaagggaggctgggggaggggggtggaggagaaagagagaaagagaagcagtaaaacagtaagtgcttggctggagttcacaaagtgtttgatgtctgaaaggcagagaaatggtggtgctggcaagagaaaaaggaaacaaagctatgtctagccacacctccttccttttaacctcttgcgcatcgtcatcgttcgtaattattttatccccttagcaacgggctcatttcaggctcccattctctctactttaaaagttttaaagactcttactaggcctcctctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgacttaaaacagccaattttagttttaaatagttgggagaaatggagttgaggttactttctgggaagaaagaataaatgagctaacatgaggaagtgcaaggtgggctccagcaatgataatttgtctgattttattggcacatgtgtcttaaggcctgaggctggaaaggtagattgaggctacatcagaatgttgagccaaatgatttaaaatgtattaagtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggttaaatacacatttgaaaccatatataaaagataaatttgatgtttaattttccaaaatgtgagctattgttagttttctcgatttttttttttttatttctatgctgatatttcattttaaccaaagaagtcctcacagcatccagaggatttcagggatgatataacttctgtagatctaaatcttttaaaaaatggagccctattccaatgtttcttctattcaaatatattgctttcatatagggaagatagataaaacagtactttccattgtctatgctgctaatttcctcaggagggtgagctagtcaatgaaacaaacaaaaaaaatgattggaaaaagtgtatttgactcttgtctataatttagaaatgctgtgtctgattcttattctgtttattcctccaataatttctttcatgtgaacagaggtctttttgattttatagtatactaaatgttcagaaaacataacaaaaagaaagaaatgaacaaaatagtgagtgcttgttcagtttacaaaagggtctttatgatgtaaatccttataatatttaagtaatacttacatgaaagttatactttgcttcacaaaatatttattggtgggtttttgaaatcatgcaaatgaattagtgttgttcccaattttggtaataatgctttttctttaatggtagtaggaaaatttaaatgtcgtttgttgaatatgtttccacacagagaatttctgttctattgaaaaggaaaattatagggatgggttgacttatttgctaagaacattgtaagattgagatttctctttcttttatgttttattaatgtcagcaagtttacatacatataagacatctctgaaaaattgcagggctttttatgtatatgtataatactagttgtattataagggaccctgtgaattttagacaataatttttcttctaaaaatagactttactcaggttatgaagttacagtattttttctataaactattttttttactgtcttagaaatgacctcttcatacctatagataaaatactattgactaattcacttaattacctaattccctttacatagtattttaataatctcaaaatagataatagaaataattacaacaacaagtagaagtttgccaaatgtaaaatatggctattaataaccaatgcaataagattatatattaatctatagacagtctcaagcatatggaaatacatataagtatttatatattatacatacatgtatcagcaaagaatgttactgtatgagcatatgcaatgaatgcttgctagtggacatgagactcctgaatatgctagttgtactgtttctggaagtttcttacagaaatattcccatcactactagtacagattttctcaaaatctgggctcttagtctttggctacaaagttaaacagaatctgatgcccaacaaggaaataatgagcattgcttcttcacagctcaagatagatctctttcgtcaattgagggaaacaatgacataatggaaagataacacagttctagaattcaggagatatatatagttcatgctttgttcctaataagttgtgtggcctttggaaaattacttgacctctctgagtatcagtcccctcatctgtaaatttagctataggacactttgttctaaattcttattgactcatgttgtcaattgtcgtggcttttcaggatgctaagtaattttaatcaggacagtcactagagagagtcataatagtaagattcttatagagccctttttttttttaacagaacatactttgatttgtcaacatttagtttcttaagagtttggcagtttcggaaagcataatgatttgacttagattattcgaaattgatgtttttagttaggccacgttaatgtcttgcacataggtgctcagagcatggattaatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggttgttgataattattcaaagtgtatatgtgccaccaaatgcagcaagttgttgctgaacatgcatttgatcacatcttcttatggaaataatattgaatcagaagcaaactttcagatttgatgacattaataagtctagtttgtaatgaacccttgtgataaagaatcaaatatctgctaaggacccgaaccaaaatatttccttggaacactttgcgtgacagtaataatgtcaatttgagtcagaacaggactatgcaaagatttaaggatgttggaatatgttgactttctcataactgttagagtaaaatgagatgttgcttagtgttagctactgtcctcagaaaccaaaagacaaacactaaacaaaaatattatcatattaagtctcacctcaatgataacaaactgagaatgagataacatatgtaaaagcaaggatccttaggattttattttttaaaagtcagtttatacatgtgtaagaaatattttttaatcacttagattttcaatattcataaaatacaatgtagtccagtataactgttatgatttaattataatttcagatataatttgataagagtagtatactatatagagattaatttgttttaggcattgtgtggagataccaatatttttggtcaggttaataagtttcttgtgctagataattatacattcttctttaatcacctgggctttcctttttagagtcttttttctttttccattgtcaaaaaatgttgattaaaaaaattctttaaaaaataatcactctttccagaactttattataaaattacaatctgtttatgctccaataaactgttaacaattataggtgtcatattatgtttaagtgatattaatgttaacacatgaaatatcaaaacctgaaaatttaaattttaatgtttatcacttaagtattctttttttaatgtcacccagaaaagttactttccttaagatttttaaaatcgaattttccttttgatgccctaaaattatttagagctatcaatatttgccttaaagaaatatacggacaggaacacaattcctatattgtaatggtctttcagttagactggaggaatcagttcaagaaatctattttatgtgatagtgactgtagttaataacagtgtgttgtatactcgaaatttcctaagagtgtatgtagactttaattgttcgtaccacaaaaaaatgtaagtaggcgaggcaatatatgttaattagcttgatttagccattccagtatgtatacatatttgaaaacatacaatttccatcaaaaaagcaaatgataatttttaaaaattctaatggtatatataaacatcaaataccagaaagaaaacagggaatactgaaaggaccggtgctcatagtgtctgtataagaagtatttctcatttctgtttcttcttttttctctacagtctagataaacttttaggggctataacaacagcagcagaaagaaataacagggaacgattttcaccaattgtggaaggtttagaaaatcaggaagccttgcaattacaggtgagttagttttgtcttaaattgcttctagagttatatttagagtactcattttgtatgacatcaactccattttagctggcatttaagtagtatggaatgtaaaactaaaattttttctgttgctagtttgtgagaattgcaatttgtttaaaattaggaaaaatacttttgaattattataaatgtggcagttatggctgtcattgatatttagacaagaatttagtaattaatgtaataaaccagggaaattgaagcctcagcagtaactaaggtaaaagggcaagcagttcagccaatgccattatcctaacaagtgttagtgaagtcggtgggcttgtagaaatgtaagacaattaaacacatctctctttgtgccattcagacaatattcaaaggtgtgactcaccagaatagaagggattgaattgcaattcttaggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccactttggcctcccaaagtgctgggattatattacatattttaaagattagtatattttttcccagtgttttttaataatacattgtttcttataaaatttaatcttgataaaattttatacctctactgaaaggttgaaaactgccttttttagatgactttgaaagttttgttcatgttcctgtggttgggcttacctaactaaatttcactggtttttcagatatatgtgtatgtttgtacttctcttcgaaagtttgttgagtaggaatgaactcttttatttatattcaaagttttcattacattgatatatttttaaaatcttctttaaataaatttttagctacaactctgtgagttatgtattattacctctggtttactgatcagggaattgaattggtggaaggcactccaaaatcacccagctgtgtaagggatagagctgtaatttgaacccatgtctttgtgatgccagaatttgaatacggcattgcctatactttgaagggatgcctctgccaatgagtagttcaccccaaacaatgagatgggaaagacatttgctagccttcaggaagctggacagaatggaatgataaagtgacaaattgttaacaagtaacatatggaagaatcatagatgtcttgttaagtattcaataaattgttgaatactgattatagatgcaaacatatgcagaccacaatttaaaatttcacattttaatgagctacaaaattagtaatttgttatatacaaaaactagtactctcacaagaattgtgaagtgagtttgtttatttagactatttaatgtgaatgaaaagatgtcctctaaaagttcaaaaatacatgcagaatacagaaacaaaaacccaaaagtttaaatctgttgtttaaaaaatataattagtgttgtattttaacagaatgacttttctatttctgtagtatcctgagacttcccaaaatgttattacagtctcgggaagtaattttgttaaaatacaggactaattattttttaaataacaactatatacattttcccccctttttggggttttaaaaaaggttattaacttctcacagattttttttcctagcttttaaagtgaaattttgtacctatgataggattttcattatcttcaggagttcaagaaataggtggaagataaatcgcatatcttcatacactctctcttcattgactttccttcagcttagtagcattctccggtctcttttgcaaagcacagattatacaccagcagcttcttttgatctgacttaaccttctaactagcctcttgtctctctttttcattttaaagtccatgcctctagaataatccatatttgttttctatgttttctaaattaccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaatagaagggaaagcacagattatacaccagggagtctggctatagataacgtgctttaactactaagctgtaactccttttatattaaaacttagcttatatctctttctgttaacctgatttttcctaagtcttctcttcttcctgtgtttcctattttcggttatagaggtatcatcttctacccaatctttaattttcctcaacacttctttcttttttgtcccctgcattcatcatcaagtcttattacaaagtatagtattgactgtgaatctaacccattctacttccactgcctttatcttctcccaccaatattatttcaacaatttcctaattagtacccatactgacatgttttctctccagacaataccctacactattgtcagttatctgtaaaaaatgagtccaattctaatacattatcattcttaaaaatctatgctcatgacccattgctaactttttcattgtggtcctaacttaatattctggcctttgagcctgtcattctcccaaatgtaccatatgtttgcgccatactacatttggtgtttcccagatatgctgtagacttttaaatgctctcaaacattttatcatgcggaacactttgcctgaaatacctgtatttccccacctatatctgtttcttctgtgtcttgcataagtctgggaaggcttcagtaatgaggtgatattttaactaggcctcgaaggacaagtaagcatttttcataaattatctttgctgatagagaagcagtactatggtaggatgagaggtgaaaagggcttccaggaggtaaaatagaggccagaatagtctggcagtcacttcataaaaaacagtgaggtaataccagcatccagttgaaactgctttctagatagccaggtaggaaaacctaaggtatactgagcatgaataatggtttatagaacgggaaagtagtatagttaaaatacaatgatgtactatcaaaacagccccagtcttcacaggctgctgttagtttgaaaggtgccatgtttttacaatatttcaatatatacaaagaagtggagtagcataatttaatacatttaaaaactgttttctaagatgctgaaaataataatgaactctgcacattttgtaattagatatggtacacaaaaacagagctgtaaatatgccctttcctgatgtgtgatagcttcacttacccagtcctcgcctatttaatagatttgtcctttggaatacaactgagaactaaaaaataaaacaaaaattaaataaaacaatctgagcagcctacaaatgtcaccagatctatcaagtaagcctcatggtgagaacgactttttggcctttaatgagagcctatttattctcttttcatatgttatctttacgaacccaattatctgttttacatccacagcagactagaagtgcaggttggaaggttgggagagagtttattccagaatcgtacactggaatcatcaagaagtgacaactgataagctggcagcaggggaggggtagatagaaatgtaataaaagactgaaactggaatgcaaatgataacaatagacttcacagagcgcagaggctagtagccctgcacacttcagtacctcccgagatactgagttacaccatacctcactaactcacatatttagtgatgaccctgactcaacaggaaattgttaaattatatctagtttattttgcgtaagaatgtgggaattatataattcatttcagagagtgtcccatgtgaaacaagatgttgatacttaaatagataaacagatatatggaactatcctatgtggcttgattctttccacagtggttcttgagtgttgagattttactgcaagcatacttgtaaattagccattaatgtactcagaccatcacatatgagggagtagctttggacaaagtattaatcatttgtcagtgaaagtgcatttataagaaaacaaggcatcgaggcttatgaatatggagaaaatttgtggaaattagcatttataaagtgttgaatgactgcttgatattacttaggaaacttgttctatttattgacagttttatattattgtcatttagaaaatagattactataatgggaggttgtttagagatatttgtacaatgtagtcatttttggtattgacacaaaactaacttctgacttaaagaaggatgcctttattttaaatctgtttcaacactgaataattgtcaaacctatcattttcagtaatagagggttgccagtgacctccatgatataaaaaggaacaggctgcttttgaagtcattatattagcttcctcagcactatttggcactattgatcactcctttatcaaagctccctcctcccttgacttccatgatactaaactgtattagtccattctcacattgctataaagagctacctaaggctgggtaatttataaagaaaagaggtttaattgactcacagttccacaggctgtacaggaagcatgactggggaggcctcaggaaacgtacaattgtagtgggaggcgaaggggaagcaggaggaagagagagaaggggaaggtgctgcacacttgtaaacaaccagatcttatgagaactcactgagtatcacaagaatagcaagggggaagaccgcccccatgatccagtcacctcccatcatgcccctcctccaacactgaggattacagtttgacatgagatttgagtggggatacaaatccaaaccatatcataagctctccttgtttttccttcacctatgtttcatttaaattctcttatttctatgcttgacccttaaatttgcagattcctagagcttgatcctcagtcctttggtactttgcttttctcatattgatgatccttgggcaatcgcatctatcctcacagcttcaattaactaccactcatatgtgatgtctttatctgatctcttctcttcctcccaactcacagaccccatatgttcagctgcctcctgactagatttcaaattcaatattgtccttaaatatacttatcttccttttaaaaaaaatccttctccctactctaatcctctctccagccttgacctgcatttctcttgtattcccaatcctggttgaccttagtattacctaccaattagcatatagcagaaacatactagtcatcttagaatctacccttactccatcttccattccattagtcaccagatcctatcaattctatatccttaatgttatatttcccttcctcgacatggtatccttctctctccaccctcactgccatttttaatttcagagcattgttacatctcactgttttatcctttccctatgttctattcttcattatggccccgtttaaattatcttccccaatgttgtctttctgaaatgcttttctcagaaatgcacttcagaatgcttaaagtccagcattggcttcccatagttcactgcttaaagtccaacaatggcttcccacagtctccagaattgcagtctagtcctagcccaaacaaaatacttcatctggctgttgctttctctttcgcctcatattccaccacccttctacatatgtttttagtctagtcatattgtgctttgtttcctatagattttatgctgttttatacctctaccttcatacctttgtacatgacttccgttggcttggaaagtactccacttctcaattaactcgctctgtacattcacatctttcttctctcatactttgacttaaatcatctttgttcctaactcctgctgggctaggataaagaaagaccttgttaatgtcaacagagtacttaataaggtcaagtgtggaacagtgtcaataaaattttaaatgtacaatttgtcacagataatggcaatatggataatctgtctgagaatgccctggagttgtcaattattgtaccccatagctctgtgaattgtgattaaatagatagatgtttgtatagttttcaagcctgtaagttaaagtcagtaaaaggttctagcatttttccagtaattttatgaagatatttgtgttcaaatatttccctttctctgtcacttaggtaaacaacaacaacaaaaaaacttaaatttctttttgtaatgctatgtcttatgccaataaaattggaaatttttaaatgtcattcacttactatattttaattattttatttgggacagttaagtgttacaaataaaccctaggcatatacagatgagctttgccttttgaaagtttatcatctgttttataatatttcaccctttataccataccaccccagaatgaagacaacagcatctggtgactaaagaatgtagatgattattgtagaaataaaataaattgttatagtaaaggaaggatcttaatgtggtagaaaactgataatgattcagtgtagtatataattatacatgacataaatgattggatactttatcacatgcacagaactggtagtttttaactatgtatgcttatgtattcatttaataggatatatatgcatctcatgttgaaatcttatgacatcactgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattgtttatattattgtatgtttttctaattaacctatagttttaaagctacatatccccagtatattaagcatgttgcaccagttaaattttatcatcttacccatccttaaaatcttttgttgcgagaatctataaatggagtttatgagacctttggaatgtgctggaaattatatttgtagtaaaattatatcatttatagtcatgagtttcctccttgctgtgtggccttatataaagttattctatctgctttgagcctccacttcatcatctgtaaaataaggataacagtaatactaatcttgtgtggtttttatgaagatgagattagatggtgaattatgtaaaggacctaatacattgtctaataactaataataataatggtgataatagtttgggatttcgtatttagctatgaattcaggatacacagaatgggtttgtcatgtttataattaagtagtaatatattcttccctttaagctaatttaaatttaattttgtatttgtaaatagtgacaattatttcagttttgaatttgagatatcgtttctattctctgaaaagggcagcacttgtgtaacggcataaaggaatagcaaaaatttagatgacctttttgttttccacattcatattacaatatacatatttctgtaaaagaatattattttatcagcttatgttggaaaatgacatgatagcatgtttattcatctgttatttgtaattaattaaatatctattagaatatgatatataataaatggtacattgttaagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctccagaggtcaggagttcaagatcagcctggccaacatggtgaaacccatctctactaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggagaatggtgtgaaaccaggaggcagaacttgcagtgagccgagatcccgccactgcactccagcctgggtgacagagcgagactccgtctgaaaaaaagaaaaaaaaaaaaaaagaagttgaagatgatgtcttaacatagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctctcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccaatttactgtattgttgttctcacacaactatgaagaaatacctgagactgggtaactttttttttattttattatttctttgagacggagtctcgctctgtcaccaaggctggagtgcagtggcgtgagctcagctcactgcaacctctgcctcctgggttaaaacgattctcctgcctcagcctctcgagtagccgggattacaggcacgtgtcaccatccccagctaatttttgtatttttagtagagacagggtttcgccatgttggccaggctggtcttgaactcctgacctcaggtaattcacctgcctcggtctcccaaagtgttaggattacaggcgtgagccaccgcacctggctgagactaggtaatttataaaggaaagaggtttaatttactcagttctgcagggttggggaggcctcaggaaacttccaatcatggccaaaggggaagcaaaacacatccttcttcacatcgcagtagcaaggagaagggccaagcaaaaagggaaaatccccgtataaaaccttcaggtcttgtgagagcttgctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacacatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaaatgagttacagttatatatacttagtttcattgcactaagacaagtacaataaggtatgagtactaacccataattatttagtcacatagtaatgaaacaggaaattttcccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacaattatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctcagttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgcagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtccaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagcgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagatttttcgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttcttttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccactgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagcaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaagagggatttgctagttagagaagatagtaaagggtatttccagcagagggatttatatatgcatgtaaggcactgttagagaatgatgttacaaagttgagtaagatggttcctgtttggaaggaacccttcttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccaccgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaacttcattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgtcatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcatttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggcgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggctttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttctttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatctagccttatagaaaaagttcgctgaccttctttatgttactggagcttttacatgtatgtgccatttctttctcacaacattcctatgaagcaggtgtcatcagcacatggtataaataatctaaatttcctatacttcaaacctgacgaatacatttttaatacccacattttcaaagtcctgaatccctacttacatgatatctaaaatttgtctcaactgcttttcaaagactctcctggttgattctgggagtctttgggaatggaggtgatcagaaactaatcagctaatgttctttggctttggattcttcctcttgcctatgccttctgtgagcatatagctccactctacacaaccattttttttcatctggcaactcctctgagcccttggattcctgacataatctccaaccctctcactccagttctttgtacataagttatatggctggactagataagtatggaacacataccccacccccctcaacaccattgttccatctctcgtctctagtctttatcttcccctgcaaccataaaaaattaataacacccagcacctcctgcagcaatcaccaaccatcaaattcagaattatatttcaggcaaataaggataccaagccatgtataatgagaagaaaccacagctttgagttaatattcaggaaggcacagcaaaacactttgattagggccacaaggaagaactctatgaggaatattaaagtgcggggttatgctcagcatctccacggaagttttttatctcaaattatttagtaataatatgtaggaggcaactgtgagtctcctagtctgaaaagtcctacattgtcaatttgagattatggctacaaatatttcagggtgttactttgttgagtcttactcagcaaggttaatgtacgtagcattaaactgaattgtgtgtaggatctgcaccaagctgagatggaccatatcaaatcagaaaagcctgtgtgtgatgaatgcccagactgtattctcaacaagaattgtcctattggcctagtgatactggtttttgtagcatcgcaattcctacagatatgcctttcttagtactttgtttgatgcacttagctcttggagttgattgctggactcactgattcgtgacaggaattctgacatttaaaataacaggaagttctctgaataaatgggatagccagaaaaatgtcagttcgtacttagaaagccagagacaaccagtgggtaaagtgactgacttgagcttgaataaggtaattcatataggttaaaggttaacaggaaaccaccttgacaacctcatttgtcaaatatagtcatgtaccacaaaacgatgttttggtcaacaatggaccgcttatatgatgatgattccataagattataatggagctgaaaaatcccaactgcctagtgacatgtagccattgtaacattctagtgcaatgcattactcacatgtttgtggtgatgttgttgcaaacatactgtgctgccagtaatatataagtatagcacgtacaattgtgtacagtacataatacttggtaataataaacaaccatgttactggtttatgtatttaccgtatttttcattgttattttagagtgtactcttgttaaaaaaaaaaaaagttaacagtaaaacagcctcaggcaggtctttcacatggtattccaaaagaagtcattgttatcataggaggtgacagctccatgtgtgttattgccccttgaagaccttccagtgggacaagatgtagaggtggacgacagtgatattgatgatcttgaccctgtacaggcctaggctaatgtgtgtgtttgtgtcttagtttttaacagaaaggtttaaaaagtaaaaattttaaaaaagttgaaacaggaaaacgcttacagaataaggatatagagaaaatatttttgtacagctttgcaatgtgtttgtattttaagtgtgattacaagagtcaaaagtttaaaaaaaacaaaaagtttataattactataagctaagtttaagttattattgaagaaagaacatttctgtgaatttggtgtagcctatgtgtacagcctatgtctatagtggtgtacagtaatgtcttaggccttcacattcattcaccacttactcactgactcacccagagtactgtccagttttgtaagctaccttcatgctaagtgctgtatgcagctaaaccattttttatcttttatatcataattttactgtaccatttctatgtttaaatatgtttagatatacaaataccattttgttacaattgcctacaatattcagtacagtaacatgctgtacaggtttgtagcctaggagcaataggctactaacctgtgaagtaggctataccatgtaggtttgtgtaagtgaaccgtataatgttcgcataatgacaaaatcatctaaagaagaacttctcagaatgtatccacatcattaaacaagatgtaagtgtactactttgaggtaaagaccatacttcagttttggtatttaagttaccacttcaaacaagggaaattcttccctaaaacctctaagacaactttatttgtccttcctaaaatatgcattacctgctgagttattgaggcccatttgaaaatacacaacattagctatgcacgctgttaaacataatgttctggtgacatttagcagtgttcagtaattggcttaatgaacaggtgtgcaagtatattagttatgcagatgttaatttgcagtaacatgtgcttcctgatttggggtgttcttgtataaactacaaccagtaagatttgttccttaattaggaaatcactacaaagtatgtctgtgttatccctaccattacaaccattagtcttgtttaatgtgctctgaacttcagaaacattcttagtaatgccattcctattgcttcaggtactatgcaggtgtcagaatgaaatctacctttctgtgggatgccttggttagtgtgcagctgtaggcaacatggagaggggaagcttcgcagctgtaatatgtagcatgtgcaaggagacagaaatggaatctcttcctgcctattgcatcagctttccctcctaaggtttggtgaacacatgtgttattcctcacaaaacagactcgataacaattgaacacaaaatagtggttccttacaaacagattcatctttaccagcatttttaattattcttttccatattgtttgtaattcctgtctacacttggcccttgggatttccaaggttaacagtttgtaaactataaaaatggataggaatgtttgtgagatttattcatatgatttttatttttatgtcaaaaaataggaaattacaaaggctaatttagcaaacgcccatctaccagccacccaaaatgaacacatgttaacatttagtcatatttactccaggtctttgcttttaaggaaataaaacattaaagttaaaatggaagtttccaaggttctacctattccagcattagattcctcctcttaggcaaccactgtcattaactggtgaatatctagtctatgtttttataattttgctacatatatactcatccatcaacaatacgcaagattagtctccgttttatttttaatttagatgaaaattatactgcatgtaccattttccatagctttaatttttccactcagcattgtatttggcatcaatccttgttgaaatatatagctgtaatacaatcactgtaaatgctgtgtgatattacattgtattaatatgccacaatttatccatttcataacccctgggcacatgggctgtttataacttttctactgttataaacactgttgaagtgaacatttttgtctccttgaccacttgacctacaagcagaaatgttgggctatgtttatgacaagcataccttcaaatatattagatgttgatgcatgcgttttttaagtcattgctgaatatttactgtcaaccattggcataatcaaattcttcttcgtatcttcatcaatacttggtattgtgagacttaaaaaatttttcaatttgatgactgttaatggtatttcttcagttattttcatttgcatttccctgatcactagtgaagttgagcatgttttcattactagctatatgaccttgggcatatgatcaagtttgtccttgatttcctcatttgtaaaatgacagtggttaatacctatcatataaagtggtataaaaattaatgccagatacagagcagatatgtaataaaaatttgatttttgtggtgcttgtgaagattgtattggtggttaccagtagtaaaactactactactgctgttatttttgttttttaatactctcatctgttgtgtattgcatatgtatttatctattgatctaatcttctttgccctttttttccatcaggttcatgtgatatttccagaaatgcatagataaaggtgattcagaatacagtagaaaataacaaaaaaaatcattaaacctgtcacatgcaaaaaccagagtagatttcccgtacctttcattgccattcttgcactcattttaatattatcaagtcattaattgaaattaaaatattgtatatttcaaccaatatgttaaaaaattatttccatgtagctggaatcacctctggaattgtatccacatggataaaatatgtatttaagtatatatggatcacaattcttatatttgtatgttatatgtaaaagaacaattggcatttacttgttaaatatacaaatatgtatgcgtgaagttacataaatatacaaatatgtatgcatgaagttacataaattttcagtgtgtttgttgacactactattattagctttatttaccctggctttgtatatagtgtacttttttgttagtttgttttcctgagacggagtttctctcttgttgtccaggctggaatgcagtggcgcaatcttggcacactgcaacctccgcctcccgggttcaagtgattctcctgcctcagcctcctgagtagctgggattacaggcgcccaccaccacgcccggctaattttgtattttttagtagagacaggatttcaccatattggccaggctggtctcgaactcctgacgtcaggtgatctgcccgcctcagcctcccaaagtgttgagattacacccagcctgtatgtagtgtacttaataggaagggacatccttttaattctcctcatatttcttataatatgatgcaacacataatgtgatgctgattcaaaggtatgatgttccctatatagaactatgcttgcactaagaaaatgagaatttactgagtggtatacatgtattcatctaagctatattttgtggatattttatggtacctaagctatatattttatggattctttataacatttataaagaaaattataaatgttaggtaccttttggggatacttccataattagtggtttacatatgaccatgcagtatgagtagatatttatgtgttgtgtaccattgtatgctcatgctaagctaattcatagtaggtgctcaagaaatatttggtagattaatgaatgtgattctggccatagaaatcagtctttctcactgaaattttaagataaagtagttatacaaattttactgtgattcatggttagttatcactatgtaaatcatgcaatgttgcctatttaaaatatcttaatacttgctacaaattataataacttgtcacatgttctgtgtatccactgggatatcagaaattaataggagattcctgaacattgcctatattaaattggggaaagaatataaccatgtttactttatttatgctgatgagcatttctcagttgtaaaggaatacatttatagtacaattgcttgtaaaaatccatgtattaaaggaaatataagaatactcagtgggcattttatcttagataatgagtatcttgatgttaacatatctttaataataatataaatgtcttcattattaggattatcttcctacagacagtattttataatgtttcattattattctattagcagtgccaatttacacactcaaattaattcaatatattggattcaaacccatttgcaatatgttttttcatttgtacggggaaggtctcgtttgactgtgggcctcattatgaacctgaggaccatagggcaattgatgataaaatcaattcatgaagtttttgtatcaaaacttaaaaaaactttttagtttcatccaagtaacttcaaataattatagaattgctatttatttaatgttttgtaaccattagaaacatacagaataaaagtatcctaggataagtgacattttgaggtcactatgaaagcaggcaatttttaacatatgatgtgttgaacactatagggatatttgatgtctcattgctgttctttgaattctctatttatctaagcctgtggtcatgatccctaaggaatgcttttaaaacaagaaggccaaaggcaataatagccactggtctgtaattatttatcatggcaaaaatatgattagttctgaaagcctgtctagttagagaactgttctaaacttgtttttctctagtgattctcagaaaagcagtgcccactcatggaactcttatcacttttcgaacccaggatttaagccaagttatataacacaaggaaaatatgttgagattcaagaaagaaaactatgaactatagatatttagggcatctaatcttaattttaaacaatttgttcacttgaaaaggggagaggctagaccatattttaattaaaaaatgcaaaaatataaagtcattaaatgagcattatctattcctgggttagtcaggatcctgttagtttgcagaaccatctttataggtccttcatggcacaacatgtttttcttatatgtacttggctaattagtctcccatagtgaattttaaggcatattgagatattaggaaaattttcttgactatttccttgactgggttcaaattagtgaatgattctagaagtaatttcaatatgattcagatatttcacattttatagacaaagggaatgactattggactgtcattttcttgtatacaattgtcttaagctggaactggcttgacaattagaataaattaaaatgttgattattgcatatgaaagactctatgctcttagaaagatcctttgaagaatatttgagatatgttttaatgtattttaaaacatatttggaaatatatacagataaatatcaacataaaatatattcttttaatatattttaagagaaatacattaaaagtcacttttcttccagtagtagcagtgactattatgttgaatccacatggcaaactgcttgccatgtctcataagatcataatttctaagtataattatccattctccttagactgcacataactttagattggccagtctggtaaaatttagcactgttaggagtttagttatccaggtaatttattttattaatatctggtatttctgtagcatgctcatttaatttttctgtattttgtaccattaaaacaaaggaagtcttaacggacttccagtattttgatgaattctgtagaatgttgcttccaagatggtaacatctatgaacatattgcctaagtaaaagtgtactgtggttttatgttgctttttctctaaaaaagaaaatcaataatgcatttgtggtctttttaacaaagattaggtgaattaaaataatatcattattgcctcaaaatgaagttatctttttaacattgataaagcagcagcatgattatggtcatatatgaaccagtgatgtaatttagcagcatgaatttgggggcaaggacctaacactctacttgactgaaaaagtactagctttacttttcttatattttctgatggccccattacttacaaccctgtttttatattggaaaaggtaaactgccaacacttgagtacaatggtagctgtaaaatttctataccggaggggtttggggatttaacttaatgctttattttcatagcagacagccacattgttttttgggccggcctacttggggagttggctgatggaggttatggaaggctaaagccactccttggcactgctactccttaccctttcagtcctttaaactgtttttaattatactgttaccttctaaagaaagcaaagtaaatcttctgttctaaggaagcaaatagtatttttcaaatagcgagggatacaaagctaaattactcaaaagaacacattgctgagtctgtttaattacatgtatgcaaatggtgctactgttgtacaaattgcaaatggttcataactattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatacaaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtaggatctcaattgctggttgatttctgtcaacattattcttttagattgtggagatctcatttggtcttatgtataaggtaatcatttgtctatagagtgaggattttgttttcttttggtatggctgaaggcatatagaccttttcatgaaaaaaagaaaacaaaattcttagaagtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaacatgttgatgctgttatacttttaataaaatcaaattttattttagccatctttctgggatcatatcgcatgccatatgaagacataagaaacgttattctggaggttaatgaagacatgctgagtgaggctttaattcaggtaacttggatattttccttttgaaattcattttcacagatttttttggactattctcttctcaatggagttgtaagaaaattctcttctataattagatttttaaaaagacattgaatagtttaataaaatcaggaatatctagctgtgttgatagtaaggggactcagtatagaaaatctaggttctaattctgtttctgccacttataagctatatatccgtttcagtataagcatatgcatatatagacatatcattgtccattattcactgtacatacaattacatgtacttcatcaccaaaatggctgcattaagtgtatattgttcttaccattttatgggtgaaaaacctgaggggtcaagaggttaaatagcttgctgaaaattagtgggtatttaacatacccattgttaagttgagtatctaacttttacccaactctgtttgggtacataacatgtattgctgattatggctagcactttctgtattttttatttcattgaatcctacagtaatcctatgagataagcactattattctcattttacaaataaggaaactgaggtttagagagattgcccaatttcacaaagcttgtaagtggtgtaagttgcaaagtaccagaactaggattcaaaacaatgtctgtcttgactctaaagctgttatattattctgctttccatgaacaaactgtttaatctttctaaacctctattttctcatttgaaattacagggtcattgtgaggttttaaccaaataaagtgctttgtatgataaaggactatacagagctgacacattatttgaattcttggtatgtctggccctgtctggtttaatttttgaaaggaataactgtaaagatttctgtggaagggtatagtcattgtagttttttctgtttttctttattttgttgttttttgtttttgagccatgagttggttttgagttttagaaaacatcaaatagggccaggcatggtgactcacgcctgtaatcccaacactgtgggaggctgaggcaggcagatcacgaggtcaggagatcgaggccatcctggccaacatggtgaaaccccgtctctactcaaaatacagaaaaattagctgagtgtggtggtgcgcatctgtaatcccagctactcaggaggctgaggcaggagaatcacttgaacctgggaggtggagaatgcactcagccgagcccatgccactgcactctagcctggagacagagcgagactctgtctcaaaaaaaaatgaaacaaaacaaaacaaaacaaaaacatcaaatagttaaatagcttatgctataactttaacaattttgccatattccctgcaaactctaaatctcagagaacctgcatatataatttgagcaagtgatgtctctgtggaagctcttctattttggattgtaggcttacattaaagtttacctcatatatatgtcttaaatctaggcgtgatttttaaaaataggactcaggtgtaataagatgacctatgtcatctcttccttgtttttagacctccattcccttttctaagcctttatctctttatctttttcatgtatctgtatattttacccatatcctgctttacccaccaattttgtgccttctgtttgctgaggacttttttaaagccaacttgctttccttctcagtaccagatactctgaagtttcttctcaatccttaccctgtttgatcaaaacccattttcttagttttgcttgtgggaagaaaacagtttaacatgtagtataatgtacataattggaattgtgctacttgggtacgggtgtagggcctaagtggcgagtaacttacctgagttattaaggttagtattgcttttatctagacaaatcaaatgtctgagtatcttctggtaaggaggatggatgctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaatatttcagaagtaggagaaaagggaatttgggtaaataaggaatttttaaaaaaattattaattgaaaaatcctggtggtagagacagtggttgtagccctgacacaaacaggcaaatcgggtaggggagaaaatactttcagggcaagggagaaaaattttacaaaaaacattacattggaaaatgtattggaggtcagaatagaggctgagactgaaaataaggatttttggagtcatttacaaagaagtgattgttagaatatcaggaccaatggagttcttaagtttcctcatgaaaaaagtaacaaatggaaagttaaggactgcatatctggggactatacatgtcaaggggatgggagctattagagaaatcagagcaaaaggagtcagcatatcagagagatggccaggatgctatagtgtatcatcaaagccaacacaagaggcttttaaggagtgatgaataagagaatgagattgggagaagagatatttccttcgatatgtcagattataatgacttatttagtttaaatagttatttttctatagttttttcttgaaacaatctacactatataccagacacctgtattccttaagcaactgttctgtttattcatggtattttggtctctgtctcccttataagggacatctgcattcctactgggcatgcaactgtctggtgtcctatctattgttcttcttccacttgtattgttttttgtttgtttgtttgttttgtttttgacatttccttccttcctttcttccttctctccctccctccttctttcctctcttcctgctactttctcttacattcttttcattcccttcctccctcattcccttcttccttccctcccttcctcctctcctccctcccttcttttcttccttccttcctaagtaaattctttctttgatgaaagaccttaattttccttaataatacctaaggtgaaatacagctcctggatgcctccatacctggaaactacagaaatacctccatagatgtttctctacgatgcatacatgggactatgccagcttgcttctatcccccacaatccccctcccccgccccaccaataatttctacatatattggctgttttacttttctgaagcccatttgagtaaccagcactgtactcaatgtgtggtatttataggttgctacacgattatgttttctcaaatgtgatttttatctcaaaacagattatatgatctatataacttattattggataccgacagaataatcagaatgacacgaagatcatctagtccattcccctgattccaggcaatgctacacctaagtcatcaaagatagatgggtatctattgattctgcagggaaaaaagattcttcaacttccctcaattaaccagttctagagtataattattcttatagtcaggaagctcatgcatgtgtaatagtagagctcgtttttgtctcctcaatccatctttgtaatcattgatctatttacgtggctatcgaccatctgtattttatgcaggcttgtgagtctgcatgtgtgcgtgcactttacgagggttgatgactttagaagactacaagtatgtcaattaaggctataatggcattagtattgtagaatttgaaaacatttttctcttaaataacaacttgtattcaccatgttcattttcataattctttagggaaaatgaaacagtagcaatgacagtaacaatcataaaacatttctttcttatttctcatcatggtggaataattatggcatgcttttgcagtctgaaaattcttttatctataagctgctcttctttcacatctttggctcttaaataggtgattaaaaatttttttttgtttttttcttttattgacgtttcctttgacccttgtttgctactttcagtctattattataattacacatattccaagcaaatgttatcgctgcttatttttattctctctatgtctattattgattaatgccagtattttcatttgtcaccatcaccagctgtgttgttgttcacagagaaagaaaaggtagctttaaacaattaattttttcttgtactaattggattgtgcaaaatgtttttaaaatataaaaaattgagcctatggccgggcatggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctccaaaaaaagaaaaaaaaaattggccgggcgtggtggctcatgcctgtaatcccagcacttttggaggctgaggcgggcggatcacgaagtcaggagattgagaccatcctggctaacacggtgaaaccctgtctctactaaaaatacaaaaaatcagccgggcacctgtagtcccagctactcgggagggtgaggcaggagaatggcttaaacccgggaggcggagcttgcagtgagccgagatcgcgccactgcactccagcctgggtgacagagactgtctcaaaaaaaaaaaaaaaaaaattgagcctatttacatttttagcaaaacgtaagtctcactaacagttcagtaagatgcgatctcagaaatcatattttatgctgccttggacactttaaaccatggtagaacttcattagaattttgattctttcatactatatccattgggtctattgaaattagacgatggtcagggtagaacaggaatttcctcataagtgtaaaactaggggccaggtgcagtggctcatgcttgtaatcccagcacgttgggaggccgaggagggaatatcacttgaggtcaggagtttgaaaccagcctgaccaacgtaatgaaaccccgactctactaaaaaaaaaaaaaaaaatacaaaaattagtcaggtgtgggggcgcacgcctatagtaccagctactcgggaggctgaggcaggagaatcgcttgaacctgggaggtggaggttgcagtgagccaaaatcacaccactgcactccagcctgggcgacagagcgagactccatctcaaaaacaaacaaacaaacaaacaaacaaaaacaagtgtaaaacttggtaagtggcctctttttccttatataaacttccaaaatctgaactgggaaatgaaaagcaaggttataccataacccctcctctaagtactagctgtgaggctacttccagacaaaaagcattagacacttagcctaagagattcagggtacaggagtcaaggctataatgtccttgatggaattatcagagagatagagaacaatcatgatttcctcccccagctagctccctattcattttttgtagcatacaaatttgttttaaatccaaagcttattggctagtcatatatttaacaaattatacacttttgtaattgatcatatctataaaaccactttctcttatgtactaaagaggtaatcaaaacctttccttctatacataaggaataaatctttacattctttttgcaaggttctattataattctagatatcctcctatgtaaaatagaaatgtacctagttattaaatcttttaaagacttgtgatagttatagtataatctaacataatataaaatttaacatgctatggcacactttaacatagtataataacgggtataacgtaatggtattttaactaatctctttaaaatattttaggaaggcaggaaggaatacacaagggaaatttaagtcttttaatttcttaaactcagtggtagacacgtagattcattgtctttgtatccatcttcgtgtcttaaatattacacaatgaataaatttaaaagtatttagcaagtgctgaaagcgtatgcttaaatcaggtttcctctactttggcactactgatgttttgggcccatttttctctctctctcttcttttatttttgactactgtcctgtacattataggatgtttagcagtatctgtggctctacccactggataccagtagcagctccaccaccagttgtgacaacccaaattgcctctagactttgaaaaatctctggggtgcaaaattttccctggctgagaaccattgtcttaagaattacttttatttctgaagtatatgtagtaaagtttcagaatttaatacgttcccaatcatttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctaatttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttctactcttcggcggtttatacttaaaataccactctcagtgtagtggaaaaaaaattcttttgggtttcagtcctgtattctgtatatgaccttgggcaagtcacttttcttcttttagccatatagtttttgcctttagaaggggggaaatgtatacttataaaaattggttattatacaaattaaatatgagcatatgttaaaaacccttgcaaactataaaatactacacaaattgaacacacatagagattagtatcttagacatttatttagctgtaacctgtcactctttctggccatttatctaaagagaattaacacttaaacattcaactattacttgaaagagtatcccaaaaagaactcatagtcttcatccttcccccaaatgaaggcctatatctcctggaatttttttcatcccctctctcttctttgatcccagctcatcatgcattcttactgattgaagattttctcacctcccatgcccataggactagactactattgttttctagttggtctttgtctctagacttcctccagtctagcacatcacattacttgattcgactaggcattctttttcctccatcaattcattttcattcttaagaagtgattgcaatgattgccacctgttttcttctgtttttaaatgctgtaatggatctctagaaattggagagtttctcagagtcttgattttgaataatctgtgcattacgttacttacatttgctcttctccatgcctttgcacctgtccttccatcctttaggtgtcttttttatcttttaaaatatgacttaaaacctactttctcttggaaatactccctattctgtaaactagactgaacattctctccattcttcatctgctcatttctactgtgttattcttaatcttttgaagtgatttttgaaaaagatgtttgcatgtgatgcagacattctgagctgtatcataagcattctttgtattggtcattctttttacttgttttcgaatcagatgcatgatacagagttttctttatatgataatgttatatcatgtgatttggtgatattttcaattagatattttgagcctgttaggctagtcccctctacaaggctatattgaatgggtgagcactctatattaaactgactttcagatttacagatttccctttcttgaatatttagggctgctttatctctcaaagatttctgagaattataagaaccacccaatgtcctttattgaataaaaggtcttcatgaaagtaaacataaaaattccatacaatatcaaataaatatttacataaggttttgattaacgcttcgttctaaatatttctgtcatagatgactttgaaatttcttgtgcattgagagatgaaacctatcctcatctacacagtttcccgggtttcatctgcctattttgggggctttggttcacccaagagaatactgatggtcttcattagcctaagtgcatgcagtcagtgtgttcggtacactagatccaaacagaacagccacttggttctgtttatgtaggttccatgttgtatataattttaaaaatgaaagcgtgactacttccagatgaagagattttccgtcagtgatgagtagcatcgtaaatagggaagctttgtttttggctgccctaaatccatgaggaagatttgaagtattacaaagacaacagatgctaaaacagtatgcttctcatgtgaagttgtgcttcccctttggaccggaggtgtcacaggtctagagaagagttgagcttccctaaaggagagcttgggaatgttaggcatcctccttagatcctgaaagcatgggcttatctgatcttagggccaagtctcctcagaagagccaacaggttaaatgtcatcaagagggtggactttcagaggatgagtaactagttggtggcacagtaagcagtcatatagaagtgactgcttagagtgggactacatctgaataaagccaggataaactctgctcaaccaacataaagccagtcattggaaaacaaatgtattgggtcaccatatattgtcatatatgctacttaatcattttatttttatggaatgtggcatatgttctagatcatctttacatatgatctatctcattgcatttcatttgatggtagagtggtggtagagtttgcctgatgaatgtttataaataaacacgaacacatattgctagttgggaaaataatcaattattttattttattttttttttggagacagagtcttgctctgttgcccaggctggagtgcagtggtgccatctcggctcagtgcaagctctgcctcctgggttcacgccattctcctgcctcagcctcccgagtagctgggactacaggtgcccgccaccatgcccggctaatttttttgtatttttagtagagatggagtttcaccgtgttcggcaagatggtctcgaactcctgaccttgtgatctgcccgcttcagcctcccaaagtgctgggattacaggcgtgagccaccgggcccagcccgaaaataatcaattcttaagcattggagtgaagactgttatttgctttatatctgttagaaacagtgtcccaggccaaatacacttatataggttatatgtatagataatttgaatactgcttcaaggggaaaatatttcaaacaaaactagatttgtaattgttgtaggatttctttgatttctacttgactagctcccctcagttcatggtacaaatgaatgactaagagtaagaattgttcgtgatcctctgattgtctctgatcccttttttttttttttttttttttttttttttttttttgagaaagagctctggggcagtgggctagaaaggggtgctcccctaggaaacccccaggccaccgctgcccgccacgcccgggcctaatgcccaggtgccccagggctcaccgcctctccagtccctgtccccctgatctcattctttctacactcagttgatgattctctttgtgaaaatgtatgggatgtttggaaagggtccccaaaaagccaaagcaaacccaggagtgtgtctatacattacaaaagtgaagggtcagtatctagatgatggtgaccagctgaaaaatgtccctgaatggctcatcaaaagaaatccatattgaattggatcagattaaaggaaggctaagtcccaaattgtaaaattttaaggcaacaatgtaaactctcccagagtaatcaaagactatctgagaacagaaggttgaattaagattaagaaaagggtcatttgagatacgtctctaatatttaggctgtgtgtgtacagttcaaagcatagtattaataaaatgtaaccatgggtgtgcacgttaccattactgtgaagccattgtttacccttctccccagaagaaaccactattctgaatctgaggctcatcaaccccatgcctttcttttgccatatatggatgtgccccaaaatatatgttatttagttttttcctttgtttttgttttgagacaggatattcgctctgttgcccaggctggagtgcagtggcacaatcttggctcactgcagccttgacctcccaggctcaagcgattctcctatctcagcaaccccacaactccctgctttccacctcctgttccccacttagatttactcacatatttaacttttttgtatacctttcttcttatatgacaaaacttccttctaggatcattttacttctccccaaaacaagtctgtttattttatttattttaatttattataattatttttagagacagggtctcactcagttgcctagcctggagtgcagtggtccaatcctacgtcgctgcagcatcagtcttctgagatcttctcaccttggcttcccgagcagctgggaatacaagcttactaccatgaccagcaaatttttaaaagctattttagcgatgggggtcttgctgtgttgcccaggcttgtctcaatctcctggactcaagcagtcccctatctcagactccctaatagctggaaccgaaacaagtctttttgaaagacttttagtgagattctggtcatagcaaacactgcttttgtttctctaattattttttttcacccttgttctgaaaatatattttcactgggtatataattctagcttgtcaattattttttctcagcactatgaagagattatttcaccatattctgggttcagttgttaactgagctgtagtctaaattgacattccctgggaggtaatctttctattctacctaggagtactaccaaagaataatcactttaaatataaattatcagcatatatttttacaactaggtagtttaaattctaacccaaaacttgcatggtggagggcgggggtgttgccttgtgtttagaagtttccagcagagaagccccttatctccaatcccagagtcaaggcaaaaccagacacaattctttactgttttcttctctaggcgggctttgttttttctccaaaataaccccttttctggaggtattaccttttggggttctgtaaaagctctagaccagtagagtttggtagatgttcctacgatagtcttggacttcagtgtctggttatgtgtctggattagtgctttctttttattttttttcccattggggagtttggggggcaagtaatgagaactttttaaaaatgtcttgccaagttagcttttcatctgaagatatttttaaagaagtctattcagcattttaggtgttctgtaaattgacagttcctctgggtaactaatcagctatattgctggaagcagaagtctattctaaagtatctctatgactctgttattgggaagttgagagaaacattagatattgataatctgccaccatgttcaggttagtgtatttaaagttctgcagatgacaagcgttgtttctgcttaaagaaaaaagtgttagcttgccagatgtgtcaaaatgtccagggtattatggatgctccattttgactttgtatttctttagtctaatggataacttatactttgttttcgatacaggcacctttaactagtacttaaatgaaaacagagaactaaataatgatagccgatcatcatgtatggcagtttctattataaatattttgaactaattgaagtgatttatttggtgctgtaatgataggggtcttgaatatgaggatagaattcagctttggaagcatctgcatgtactattttataataatgaatcctagcattggtttgtggcagtttgtcatggccgtgataggatgatatctaatgaaagcagaatatagcgttaacagggtatcatatatctgtcaacctattttgtctgttaaaaatctattctaggccaggcacagtggcttacacctataatcccagtgccttgggaggtggaggcaggagaattgcttgagcccaggagttcgagaccagcctgggcaacatagtgacaccctgtcactataaagagttttttaaaaatcagccaggcctggtggcataagcctgtagtcccaactgctcgggaggctgagttgggaggattgtttgagcccaggagattgagactgctgtaggtagtgattgtgctactgcactccagcctgggcaacagagtgagactgtgaaaaaaagaaaaagaaagaacgaaagagagagagagagggagggagggagggggggaaaaagaaaaccagtaaaccagttaggaaagggtaggtatatgtaaaataggtgaaggatggatatcaatcagaggaaagcacgccaaacagaaagacaagttctcaatcctgcccaaggatttaatttgcagcttggctttcaagctataaactgtcttcggcctggagttggggaattggggtttcaccaggtacccacccgcgtctgcctaagcatttggctgcctcctgttgctatcattacatttagacatgggcatacatactttggatgctgctattcaatactcatagtcattaatttattctatatgtcctactttttaatgcttaatatcactttttatgtttaatatggtttataatttttattttagagtacaaaataggacataaacaaaataaaaggtaaatagcatcaaaggagtacttttcataattatcctttatactgtaaatcataaattatgtagaaagcaatacatgtattttgcaaataggatcatgacattagtgggagtagaattttttacatataatcactattttttctattatagtagtaaatatatctgtgatcttcactgatctacttagtacagggctagaaccccttgaatagtttaattgaatttaaaataggaaatgtttagctaccgtgtaatttccctagcccagatttttggctgtggaatggaaaggaagggttgaacctgaaagagattttttttaggaaaaattgtcagaagtgtgactgaaaggtaattgccagtttgaaagcttagaagatgaaaaggatgccagttctgttggcagaatgaagccattaggagacgctgataaggtgtagggatgggtcagagtgaggatgagttctcctttagatttgttcagtttgagttaatgatgggacatctgggtgggaatgtcagttagaaacatggagcttgaggatgcctaagagtagtcagggctggagacgttcatttggcattatcagcagtgaggtgatattgatcatgggaaagtcaatgcgccttctagggaactgagtataatctgaatgttaaatgtcagagtttcaaatcatttctttaggatatgtttctctgcctgggctagattaaagattagataggaaacctttaaatccccgattatttctaagacacacttgttacttcaaggtcaggaattttctcatcgattttcaatgcttgtgtgttattttattaactaatgtgtttttgaaaatagtgactgcatgttgagggattgaaatgctccacccccaaatactttagtggtaatcagcattttaacatacttcagtatgtatgtcgattcttggagtcaaatgcaagagttttggaaatgttaggaattttatatcaaaaggagaagattgtaccatcaccacctgacagaaaatgtattttggatcaaatggaaggcaaattactcagtcatatgttgattgtgttccattgtgtaaacaagaacatacacagcccttttggccctgtcatctttatgagggcagaatctccagaggttaatgtggtggtagtcacgtggtagacatccagtatatattggcagaatggatgaataaaacagaaaataagtatagaaccaagtactggcatgaaactgtcatttcatttgaagaaaagtaaaggaacacatgatttaagaacagtaaacacatacacagtgatttaagccatataccataaaaaagttctgaaaaacatgggtaaggaattgtgttttctgaccaagcaaaatggggaaaagatgtgttatgatgatagagatttagccaagggacttttagggaaatgtttctttttcttttttttttttttttttttttttttttttttttttgagatggagtctcgctctttcacccaggctggagtgcagtggcgctatcttggctcactgcaagctctgcctcccgggttcacgccattctcctgcctcagcctcccgattagctgggactacaggtgcccgccaccgtgcctggctaattttttgtatttttagtagagacggggtttcaccgtgttagccaggatggtctcgatctcctgacctcgtgatccacctgcctcggcctcccaaagtgctgggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctgaattaattttgccagcttccatgtggcaactgtgggttcttgttttgatcctctcccctggggacaactgtgtgtgggaagaggggaggagtttcccacggggcacagctggtggtgtattgaagccttctaggtgccaagggtgtggggtgttctctggcaaagtatgggaacatgtattttttccctgctttcctttttaaatgtacttgattagaggagtaccaaagcagtgctcttcacacagttctcctctccacagtactcagacatctgaccacgttggggatgaatagtctgggcctggaatcacatccaaaaaacaactacagtgcactcagaatcaccctaactctttccaaattgcaggttttctcactggactaatcttgtctgcttgctgcttgacttctctccctttacaaaatgtctttcctgggagcccccttagtccactacacaaacagacttcaggctgattccgaggactctgtatatcagtgtcaagctgtgccttgaacccctgccttttttccatattctctgttggtatgcttttgatgagtaggtgaagtggaggtaaatgagtaccattacatctctctctcctctgtattatcttccttcctcttttatttaggaatttatgggaatgaaaaaatactcctatccaaccttatactacatctttgtctacaacgtttagtatgtacatatataaaaaatcagatatgtttaggcattgactacaaggaccacttgcaacatgagatcctacaggtaggtgactcataagagcaatatgtactattgtagtagtctgcatctgccgcacatttgagagtgagttttattctaattcgcaagtacaacttactaaacagtggcagttacataagcttaaaactcataagatgatattcagagtcagaatacatccaaggccactaaatgtgttaaatatttcatacagctgaatagagaaaagatatgtcacctcccactgtggcgccttcattctgaaaataacaggttacctatagctaggagaaaaataaaataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactcctgacctcaggtgatccacctgcctcggcctcccaaagtgctgggattacaggcatgaaccactgcacccggccactggcctcttcttaagagggaactaatcatattcgtgagggctccactcttatgacctaattgcccctcaaaggcgctgcctttaaggataatcacgttgaggattagatttcagcataaggattttggagggacacaaacattcaattcataagaatcatcaaatttgagcatgcatcagacttcatcacttttgcttgattctccattaaaaataggattgtattgtgtacttaaatatagacattgtagataatgggagatgttgtacaagccaggtgtaatttataagattgaagattattccaggttttgaaaaattatgaatggtagagttgatactttcttttttagtattattgtacctaagcaaattctacatagtatttttctgtttttagtttagattgactaattattgtgactggaaataaagcttaaaaattattctaaacacggtgaaaccccgtctctactaaaaatacaaaaaattagcccggcatggtggcgggcgcctgttatcccagctactcgtgaggctgaggcaggagaatggcatgaacctgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgatttaaagcttaaaatgtgctgttttagctgggaagaaaatcttatacatcatgtctttaaatcatcatgtagttaaattattattggaatgaattattttttcttattccacccttcatattaaggggtacaaaggatgaataagtataaattttgaattcaagattatagttatattttaagtattccccaaactgactattcaaatagttgacaaaaaacaaaaacaaaaaaatggcaggaaagagggcattatgatttatttaatttcttggagaaaaagctattttttacttaggtggtcagtgcaagtttgtttgctgtatgaataaatagttccattatggtcaccaactttaccctggctccctgaacattttccatttgcatactaaaattttaaaattaccattgaacctaatagtcaaacattttcagcgttatccaaaatattctataagcttttaaatagtataatatgttagaactgatccaatttgataccttgcagtttaaaaatcctgtttaaagtcaaactgtgctagatgggactgagcatgttccttttgaacatgtgcaataaatgctcacccatatttagagtttattaattttgagacatggcattgactgcacttatatagaaggattctgtcaaattcttgcaaagaaaatcaggaatgtatgtttgggatcagatagagcatataatggtatctgagaaaggtatttctcttatttttgaacaaggtgaattaatcaactaaattcgatagatatcatttgttaactaaaagcaatttagcacaacattgagtaatacagttatttagatcaaagtccacacttgaagcctaagctgcttggattcatattataattgaagcaagggtatataccctctgagaattcagctgtgtcatgatggttatgagttttacagtaggtatactacacaatttctctgaagccatttttttttttctgaatgcagtttatcttggaagatgtattagtttgccaagcaagtcctttcaagaggcatatccttggtaccacactgaggaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaattattaagcctaagtccgagcctgaaattagaaagtagtatgatttaaatctgtaacaatagaaattttgctaaaacatatttctctaggtgtatgctgaaattcaattcacttctgtgtgtatacatccaaacactttttaacccttaaacatatatcaacagcctaatgtgaggacagttttggaaattgtttaatagaatcatctgcagtaatgagagaggctccaaactggaaaggctcattgcctctgctcacttctcttgttaacattattagtgtatttatcacatgatttctatatggaaaacctccggtgtctccctgaatttacagaatgaagctccttcgcattctcactgtatctctgactgtcttgctttcttcctttctgctccctttggtgaagtgagtcaattggtatctttttgacattttagcctttatttcaatcagactctcactgccgttttaacagctatttcactcgctccctattctgcgtcctttcatttttccatagtggccataccatacctttccttctctcctcaagtcttctgtctcctccccattcttttaacttaccacgaacatcctaacctgttacttgccagagaaaaaagaaagcagtttgacttcaaaacctccaatatttcttctacctacaaagttttctctagctatataccttttacttattctctgtcaagcctcagaaaaagaggagctccattatcattaacattattgttgttgctattagtatggatagaaacaaaataaatattgaggacttaatttgtcagattctatgagaagcatgtttacttccaccaacttatgtattcctcatgacaaaccctacgagtttggcactattaatggctccatattaaggatgaggatgccgggcgcgttggctcatgcctgtaatcccagcactttgggaagccgaggcgggaggatcacctgaggtcaggagttccagaccagcctggccaacatggtgaaactccatctctactaaaaatacaaaaattagctgggcatggtggcgcacgcctgtagtcccagctacacaggaggctgaggcaggagaatcgcttgaacctgggaggtggaggctgcagtgagctgacatcaggccactgcactccagcctgggccacagagcaagactccgcctcaaaaaaaaagaaggatgaggaaactgggcccaaggaagactagtttacttgtccaaggttacatagtaactagtagtcacagaattcaaatgttagcagtctgaatttgtagccagtgctttaaccactgtgctcctgggttgtgggtatgtgggtgtgtatgtgatgctctaccacatgctaatcttctcacttcagttttgggcattgttatgcactgcctactttaggtggtagtatctcttgcctgctttccttctgttagttattttattacttcctcaatttgtcagtttccactctgccctgctcttcagaaaaaaagaaaatcttcagtcatttgctgcctggaaaggagtggatagatgggtggatggatgaataaaaatccttcctgactgaggtttctgcttgctactgccttctctccatttcctagcatcagtttttttcaaagatcagtctcctttttctctctgcttccttaactctcattcactgttcaaccaatggtgatcagaattctgccttaaataatgcattgaaattgaaataagaaaggcccttaaatcctgttcacatccaaaatacacatcaaatatactcacttctctgtctccatcaccaccaccttagcccaagccagaatcatcgtttcaattaaccattacaatatacatttatcttgtttttcccgctaccacttttgcccttctccaaatccgtctcggcacaacccttagtaggatgtttctagagtgtatctgtattgcatcataatttttatctgcttaaaataccagtgctgttctatagcactaaagctacagcattaacttcttaccatgacctagaagatactatctggtctggcacctgcccacctctcctactttcatcacctgctatttggcctcttgctcattatgcctcagccacattttatttttgaacttaccatgttctttcctgcttaggaccattgcacatgctgctcctttactcctgcttgctgcctccctctcttgtttatacttcaagtcatagcttaatttttgctttcccagtggtaccttcatttgcctttcagtcagaaatagatcttcctactaaactctcccagattaccttttttcttttcctttctagaaatcatcctggattttaattaaatgtttatatatgaggttacttcttgactgtctataatcccaactatattgcaagttctataaatggatgaactatgttgattttattcacgtgtgcttaacaaatatttcttgaatgcatttgcatgaatggaaaatcaagtggactctttcagtcccatcttattctgtatctatatggcatttgataacataaaagaatttaagctcctttttgaaacctttcctctccttcttaaataataaatagtatttcctgattttttttttttaagagctgcctcttaaagctcttaaagaaagttctctctgtgtcccccagggtggagtgcagtggcgagatcatacctcactgcagcctcgaactcctaggctctagtgatcctcccacctcaacctcctgagtagcaagttccaccatgcccggctaatttttttaaaaatttttctgtacacatggagtcccactgttttgcccaggttggtgttgaactcctggcctctagcaatcctcctgcttcagcctcccaaaatactgggattataggtgtgtgccaccatacctggccttatttcctgattttaatactctaaccctgtgtagtgccctatagagtttccttgattatataacttcttagatgataaaaacaaaatctcatcagttaggggtgtaaatatgccagaaattagattactcttgcagtattcattaaaataatgataatgaataattaacaaattggctggtcatggtggctcacgtctgaatcccagcactttgggaggccaatgcaggcagatcgcttgagcccaggaattcgagacctgcctggccaacatggcaaaaccccgtctctacaaaaaatacaaaaattagccaagcatggtgctgtgcttgtccagctacttgggaggctgaggtgggagaatagcttgagctcgggaggcagaggttacagtgagccgagattgcaccactgcactccagcctgggcaacagaaccagaacctgtctcaggaacaaaaccaacaacaaaaaaacacaataaaattgacaaaactgggggaaattgtgaaagaaagaaacttatctaaggcagtgactgggacactaagctttctctaaccttttgggtttttttagcagccacatcattaggtttgcttataatcatgtgcaaccagttggaaaaaagagaaaaaaaaagaaatagaaaaacccagagacttttcctctgtctagagacagatcctggtaagggggacatgctcgctcccacatattgtatgatcaataatcttgtttagggggtagattggctgcatagcttcccactgacttgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaaccacctgaaaattgaatattcaaattaggtcagtaggtgtcaattaattttgctattgattggttttcattaaattttttaaaaatcaaaagttaaccctttcatttttcccctccacatatcactaattcctaacaccaccatagaaatttttatggctgtgtccaggcatggtggctcatgcctgtaatcccaacactttgagaggctgaggcgggtggatcacgagatcaggagttcgagaccagccttaccaacatggtgaagccccgtctctactaaaaatacaaaaattagccaggcatggtggcgggtgcctgtaattccagttactcaggaggctgaggcaggagaatcgtttgaacgtgagaggcggagggtgcagtgagccaagattgtgccactgcactccaacctggatgacagagcaagactccatctcaaaaaaaaagaaatgttgatggctgttcttggcctcaaacatgttttcagaaaggtgttttaaaattcttgcctaactttttagtgtgattcttctgagtttatagtgccttttgggacacacaatgttattgtattctgttctagactaaagacaagtgaatggttgttgatgggtagtttccacatatttttatctttggggaaatattctctaccagtacatcattatttttcttttttctttttctttttcttttttttctgagatggagtcttgctctgtctcggcctcccaaagtgctgggattacaggcgtgagccactgcacccagcctacatcattatttttctgatgtagaatcagttttcaacactcaattttttcaaggcttcaattcacagattaagtatggcccttttctctcatgacatctaatgtacgaacatttggcattgactccatatagttggtacacttgtattgattattttttccaggcctggtactggatttgctacagaaagtattagaatgagtataagtaggagaggttctgccctggaggaggttgttgtctcaaagaagataacagtctttactttataaggtgtcataaatgcccctgccttatttccacaactccaggcagaaatctggtcagtattgactcaatctcatttctgtaggcagttctgccttctattaaacttaagtccattctcctttaatgtggtttcatgatcattctttttgttatagtcacagatacaaaaggattctgtatattcaatgggcaatggatcaaaagagtaactatttggaaaaaataccttgtagcaaatatatatttgttacaaatttttctgttaattctaatgaattcttaacattatattttgaagagacggggggatcagtttttctcccatatgttaggccttaatggaatatgtcttagaagtgaaaaggaaagatgatagaaataaccctaaaggccacacctgaccataggagtgccatgtggccatctccttttccgtcacatatgatttttacatttgtgctcttttcctttctcggtggattcgtaggttagttgggtagtagatcaatattcatgagctgcgtaggtactgaagtgtgtaaaattcaaattatataaacaaaactgtgtctaactctttggggaaataacccacttgtagttgctctcactaaagctgtcaatgcacttcttttatttttttttaatatagtgaagatcagctaaagaaatgagagccacttgatgtgatttgatagacaagtacatcgtaacacaaataaatcccctacataatacaataccctggtcagcatcccacagcacttcaaggaatgaattataaaacaaaggatgccagtcaactaaaatgctgcaagggaccacaactaaatacaaacacaaatttcagcagagtttttattttatttacttatatcacttaggtgcactcaagtgcctttatgagacatgagccttttaataattgtatctgtggctggggatgttgctcagtgcttcctactatttctaagcttagttatctaggacatttccttccatatccaaatcctctgatggagttgcaactgtttctatcagtgtacactggtctgatcgtaaaaattcacacttatggttgcaaaaattctgtggttatgatcaatatgtactggtttgtggcttttgttaagagatgcacatgtatagcttgcctcctacatcatctcttgattttgtaataatacaattttaataatgacatttctaatagtagatgtatattatgaattaaaaatagctaaataaagcatgatatttacagtggataatgagagctgttcttcactgagccctggaaatatatttcttaattttgaatgagagaaattttacgttgggtttgggggaaaagataaggaccccggtttcttcatactgacaatttctgaagatgaataaagaatgtaataacaacaagaactattgttttagggtgtttacatcatgtcagttactatgacaggagtgatacacatagtatcacatttaagttctaatgcatcgtgtatagatgatttaatgaatacattttcatgatgaggaagtaacttagaaactccaggtaacttgcagtaggtcatacaactagaaagtgaggcccagtgaggtcacttacatctgaaatcccagcactttggaaggcccaggtgggcagatcgcttgagccccaggagttcaagaccagcctgggcaacatggcacaaccccatctctgcaaaaaaatacaaaacttagccaggcatggtgacatgtgcctgtagtcctggctactcgggaggctgaggtgggaagatcgcctgagccccgggaagtcaaggttgcagtgagctgtgatcaccctacagcactccagcttgggcaacagagtgagaccctgtctctaaaaagtaaagtgacagaagtgtggctcaaacctatgtctgtgtaactacagtgtcgctgtttctcctactgcagcttacagtatgggtctggagaatgcagataattgtttccccctctttcctgggtttagagaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaaggattggtattattataaataacattgtgtttactgtgacttgaatatcacttcaagatttggggtcttgaatgggaaaataagagcatcattgttagaagtaagatgccctatttgccgggtgcagtggctcatgcctgtaatcccagcactttgggaggctgaggcgggtggatcacaaggtcaggagatcgagaccatcttggctaacacggtgaaaccccgtctctactaaaaatataaaaaattagccgggcatggtggcggctgcctgtagtcccagctactcgggaggctgaggcaggaaaatggcgtgaagccaggagacagaggttgcagtgagccaggattgtgccactgcactgtagcctgggcgacagaacgagactccgtctcaaaaaaaacaaacaaaaaaaaaaagatgccctatttgatgtctgagaagatggtcagctgaatttacttaaatgctaatacaaatttttcgtagcagccaagcaatacttttcctttatggaactagtgctttttactctaccttcccacagctgtagaggcagagcctaaaaaagaagaaagtaaacgtatggatcatttattttgactcccttcttttcatcaaaacaagaccgctttacaggaatttctcccactttacgatggggaaactaagaccagaaaattaggcagactgttttcacacagtcagctcacatgacagtttctaaattcagtctcatttgacttagttgctgctaagctacacctacctgcccctgctgccttagtccctgattggcttactggaatttaagtagcagcaggtcagggaaagcaaatccatctactctcattctctgaaacaagcaaacaaccaggtgacaaactgtaccaaattagcacatccttctaccttcattattgccggcagacttcaaactttggagccatctttgactttctcctgctataactggtcggttactaagtcccatttattcttccttaattctatcttttatatccattgttttctttatcttcctactgtcaacatgctacctcattacctgtttcttacaccattttgctaacttcctgatggtctccctgccattaatctctccttcaaccaatcatacttactgctcctaataagactcaagaggcagtgtggggtagcggttgagagtctggggtctgtagcccaaaggcctgcattcaaatcttcaggtttccaacataaaatttgattttgtgcaagttacttactatttgtttcacttttctcatctttggaatgaaaataacgataaccgtttcctaggattgttttgagaatcaaatcagttaatatataaagcaaatgttgaaaaatgtctggcacaaagtacttaataagtgttaattgctgttagcattgttaccatcattatcaaagcatactttggttatgtaatttcaattggagctgatatttttataaaaatatcaaatccatgttctctgagtttgtaggccaaacattgtaggttaatacaaaacatggaaaggataagaatatgattgcaggcacatgatattgggaccaaagaagactaaaagcccacatatgcctaagggttttgttccttgtccatctgggaccaagggcaccctggtgaacatggcccctataagctctgcaaagtatggccaggagagcaagtgcatggtcactagtagctgctcaaagtagctctatagcttttttagtcatcagggagactaaaaaactactccctaaacgtaaaatgatagaaaacctgcttcagtgctagtgatggccagttaccagtaaaaggaaaggaaaaataaagtggggagggatttggagacagaggtagaggcagaaatgaaggcagaaaaatatatagagaaactcagagtgattcccacacaaacatacacaaagagacctgcaaattcacggagacatagactttgatgcgattagcttccacttctgcggcctttacctggactctttagatacattgtttccaattctacccctaggtatgtatgtcatatatacctagcctataaaccttttctcacaccattctctctctctttacttttctcacaccattctctctctttactccctccttccttccttctttccctttctttcttttttttttttttttttttttttttttttgagacagggtctcactctgtcgcccaggctggagtgcagtggcacaatctcggctcactgcaacctccgcctaccaggctcaagcgattctcctgcctcagcctcctgggtagctgggattacaggcactgtgccaccaccaccatgctaatttttgtatttttagtagagacagggtttcgccacgttggccaggctggtctcaaactcctgacctcaagtgatcctcctgcctctgcctcccaaagtgctaggtttacaggcctcagccaccgcgcccggccactttttccttttagtgtcagttctatgtgtgcttaaatttacacatgcatgcacacacctatacatatattttttcatgtgtatttcctctactgtgaagccttcattaatcactgtaatcataagagtttaaagttttttcttcttccagtgaacacctccagaacttaatttctttttacctatctaaaatcatgtgctggctttttcaccagcaatagttttcaaggttctatgttgagtttcagactatattgtaagctttttgtgaataggtggcgtgttttatagttgccatgtgagtactgaagaaatagcagtacaatttgtataataataccctgaccagataaaaaaaagtgagtcataagtgatgagacctacaaaaatacagtaacaggtagatatttcatcatacttttgtatatctgcctgtgaaaagcatgaaagcatataggaggattagtagaaggcagaggttcatatttggagaggcagatgttcatggttaatgggcaaattcgaagaagaaaaataatgggctatgtcttgattctgtattagagtagatatggtctgcccaacagctcatctgctgcttttgaaaggtactttgtggtttaaaaacttttgtttatgtcgtcaaattctcttcatgttatctgcagatatgttggtgtctaatctgtacttggcatttgtatttaaggaagtaggctatatatacaaaaccaaatataattaggaatgttaataatttattttcactgtgtgcatgtgtctgtgtgcgttcatgtgtgtctacctctccccgacctccctcccagaattcattttgtgaaggaaaactagttgagtaacttggagctataggaaattaaaaactaaaacaattattatcatagtaactataccaagtggaatatttaatgtgcaccagtgctatgaaacaagtaattaaaaccaaagttgaactgtattgaagaaaaccaatgtagaattcttgcataatgtacttgaaagtaagttcatgtgattttactatcatctaattacttaacagcagcatctgtcaagtaggtgaaattctttagaaattctttagagtatatataaatagtatattttatgaatagaaatcataagtttaaaaattattaaatgctcaatcagagctagtcttctgatttcaaacagcatagtaataggtaatttcttaggaaatgttccagttatattttctgtcatcatgtacatcttttatctgcggcccaactattcactcaactcaatttcatgtttataaattttcctagttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtcgcttgaacacgggaggcgggggttggagtgagccgagatcatgccactgtactccagcctaagcaacagagcaagactctgtctcaaaaaataaaatataaaataaaatagatgcagtattatatttcctttacattattacttatatcgttctaaaaagtatctgacaagctaaatttaatgagataaatagccagaaatttatttttgaatatagtttgcttattctactctaagataataatactcttcaatgtcaagtagtgttgtacactggtatctggtgcattaactaagaggtaaaaaagaaaattgaataacaatcatcttgttttgattggatcatttaataatatttttgagacttatgaaaagcaaacaaagaaacagagaagcccaaaagtgcttgtatatgtccatttttaggctagagcaaaccaccttattcaaagaaaagatctgtctgttatagaagcctgaaaacactctgaggtgaaggcctgtaagaaagctagagacgaaaataaatctgaaaacaagcaatctgtctttgacaactcaccattctttcactcttttttttctctcacatctgaaaatattgcagaactttggttagttcttgaagtatattataatgagaatcccaaatctagcaatggatatgaatttcttttctatacatgcattaaattgatgttcattacatatacatggactagcactttgatatgtatcaaaaatgatttgatcttggtagttctaacccaaatagacataaagaataacacttatagataataataggatgtacaatagaattgtgaacatctgtttactcctgatatatttttgagggctgtaaggaaagagaacaaggaaaatacagaagattatctggaaatgctggattttgtgaagaaaacatttttacccccatcttcttgtgatatttggggacatgtaaaatcatttcataatgccagagggaataaggcagtgcttgtaataaactgtactaaatcatgccagatttataggatgaaataaagtatttaggacttcagcattgtattgcataccatatccccaatgttaatagagtcatctctaccatggtgctacttgcctagagtatatgctatatgcacactgagtgaatctaaaagtgttcttgcttgacaattataaagagattataagttaaaatatcatcagaaatttgtattagatacctattttgcatttaattcatataaaaatatttaaaaccattctaatttgaagaaatatgtaccttataagtgtcttaatttcacactattcaaattaattacatgaactgatttctttgaagcaagaatgaataagtcatttatacataggaacaaaaggttacgttaatctcaccgaaggattttacagttacatcttatattttggagagaggcttctttctgtcatctacctgtcaaataaaagttcttctacacaacgctgatctgacatctatcactagaggtatgctcaaaggattcagcacaaagatttttgccaacttcaaataaaataaaaaataatcttgcgggaaatactatcatgtagcaataggtgttccaaaagtgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcattgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtgactctgcctgattcaagcaaaaagtgaaacttgctggaaggatatgaagtaactaagccagaaactgaggaaagactaaagaacttgccctttaaaagaacagcaactgtgacagctttgagaattcaggtagcaggaatgaatgaaaagtctttttaggatgttgcctttgggatatatcagctccaaccattttccttctcctttccctatgtttgattcaaattcaaattatgaagagagcctaatgagcccggtgtggattataagaacaccccttgttcaagggagagcaaaaaaccctgattgacagtgctaccaaaactacctgccatggaagattggttatgccctaaagggtgctgttaccaaagatagggctaccaaaggttaggagcaggtaaagggatatcaggcagctctaaacaaatacaaaataaaacagatgatctattcatcagaggcctaccaacaatagagaagatacacagaaacctcaagaagcttgtggtacagttgagcagccaggaaatatacatacacaatattatgtaatgtcacaaggtacactgtcaatgagggcaaaaataaatggccactgagattagcagtagttcaggggaggaaggaatctttggtgattgggcagtgctggtaaattgaaaaagaagaatcttgaaggataggtaggattaagaatctataactttacaaaaggggagaacattgtggcttggaacctacgttttaacttacacttttgtcaattactagccaaattttcctgactaagtcacttaccttctctaaatctcaatttgagattgaatatttcttgaatatttctcccttcacttcttgtatctttttttggatttccttgcattgggcttcacctttctctggtgcctccctgattagcgtaataaccaacatcctgaattctttttcaggtaaatcagggattttttttcttggtttggatctcttgctggtgagctagtgtgatttttgggggggtgttaaggaaccttgtttggtcctattaccagagttggttttctggttccttctcatttgggtaggctctgtcagagggaaaatctagggctgaaggctgttgttcagattcttttgtcccatggggtattctcttgatgtagtactctcctccttttcctatggatgtggcttcctgagagccgagctgcaggagctgcagtgattgttgtctctcttctggggtctaggcacctggctctgggctggtactgggggttatctgcacaaaggcctgtgatgtgaaccatctatgggcctctcagctgtagataccagcacctgttctggtggaggtggcaggggggtgaaatggactctgtaagggttcttagctttggtggtttaatgttctatttttgtgctggttggcctcctgccgggaggtggtgatttccatagagcatcagctgtggtagtatggagaggaaccggcggtgggcagggccctagaactcccaagagtatgtcccctttgtcttcagctaccagcatgggtagggaagggccatcaggtggggcaggtctaggcatgtctgacctcagactctccttgggtgggtcttgttgcggctgctgagcgtgagattcccagctcaatggagttgtgtacctaccgtggattatggttgcctctgctgagtcatgcaggttgtcaggaaagtgggggaaagccggcagtcacaggcctcacccagctcccacgcaatccaaagggctggccccactcccaccatgcccccactaacagcaacgagtctgtttccaggcagtgggcaaacagggctgagaacttgccccaggctacccacctccgagctgtgaaagaaaagggctttagttcttcccctgcctgtagagtctacacagcggattcacgccctccactgagttctggccaggaggcttcttgaccacttcaagttgttacaaagatcagctggagactttcttctccttgtggcttttccccttgtgcctctggctgccctccggaaggatccctatggtgccaggcaggaatagcctgcttggggacccagcgaactcccagggcctttcctgctgcttcctctacccctgtattttgcttggctctctaaattgactcagctccaggtaaggttggaaacttctccctcaaactagaccttcggtttccccagtaggggtgtgtgttcggtggtggaggatctccctttcccacttcgcaatttgggcactcacagtatttgggtcctgcagcagcagtccccttccttcagagggtctgtgggtcctctcgggattcctggtttatccctgcagtcgttttggagctaaaattcacaacgcaagcctccgcacgcttctctgtccatccgagttggagctgcaatctagtcctgcttcccgtctgccatgatcctcccacaaattcataaactttcttaaaacattatgagagttttttgtgggtttttttttttttttttttttttagctcatcagctatcattagtgatagtatatactatatatagcccaagacaattctccttcttctaatgtggcccagggaagccaaaagattggacacccatgatctagaatatctataacatgtaaagcctcatctagaggccattacatggtattagtgacaaagtatcataccaactatacaaaggaaacatccatctccatccatttcccccatagaagttgttagaaggaaagtaaaataggttcagctttattgtgaaatagaaaattactgcagaaaatatgctttgtaaagaaaagtgactgctgtctatggtagtaaaatttggaaatctgtaatccacacacacaaaagaatctacaaaagaccttagaaaaaagtcatatgtaagtacacgcaaagttttgcagtgtctaatcatttctagctaaaataatgtggactatgtccatataaactcagaatgtcagcatatgaatacatccagtctaacctcttcagtccacaagtgagaaaactgatgcttgtagaagcaaaatactttagtcagtgtattgttcagcttggactgacataacagaaaccaaaggctgagtggcttaaagaggagaaatttattttttcacagttataggactgaaagcctaagatcaagatgccagcagggttggtttctggtgaggtctctctccttgggttaccatatggccaccttttcaccgtgtctttacttgacatttaatttactgttttcttcccctttgtccttcacaagactcagaactcgtcaaatttggatgtatattttattctgcattatatctccagtgtctattatatgtgaagctctcaatatattactacagattgaaagtcagacaatttgattaaatagaggatttgttattaatactcagcatgtgttaacttgttttttaagttagaacattttgttcctcacagatacaaagggcatatttttgccagcaaaactgttgaatatgtaactgtaagattttttatgctttatttgtaaagacgcaaaaatgtgttgtttgctgtaaatctaaatcagcaactcattattaaatatgggttattaaataaattaacatgagactattaatttaaaaccaaagatattttagaaaataatcactataggatgtactgaaagggaacctagcaacgatcaataaatcctggtcaacagtccatgcatttgtttgcctgtgtttttatagtttataaagtgttttccttgtgattcagggaggttaagtattattgaccccattttgcaaattagaaaactaaagcccagtgaggttatataatttgtccaagattcaaaaactagtaaaggtacaagttggggcttacatacaggttttctgtttacaaaattgtgtagcaccctgcctcttattgcattgtaacaatgtttggttatacttggctcatttcaaggaagcattatagaaccaactctggcacttacagtattctgaaaatggggaaaacctcatgtgaattttcttggctctctggcatgaaacttggaatccatcttttttattttaattcagcttggtgtaactgtaggcctatcaataggaagtttctcatcttgtaatagattttaatgtatccaagcagcagagcctatatatttgtaataaaatagcatctaataatttgaataattgtggagctatcccttggtgttgtatagactgtcagagtattttagttttgtgtaggcaaggttgactgctgttttcaatattttacaaatgaggatctgctctccagagagatgatctttacccaagatcacttagtgatgaaggcagagttaggatccagcttttcctgggactcaaacaaatgatttcagtggatcatgctattttcagaattttcattgactcttttgcttcactgaaatatactttttcctatcagacaatatttagcattaattgaatttgagggagatgtggttgataatttgctgagaagaaaatgactttgtgggttataatttgtcttgaaaaaaattatgtgaaagggaagattagactctcgatcatttatggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaatacgctactgtgtgctttgaagattgtccttcaattagcaagtcagtgctttatcccacttctaagatgtcagctacctggtctccttgtgtgtctatatagtatagtggtgcacatacagattgactacttaagtagaaagaaaacttgatgaaggtaatatgtgtctctgtcttatgaggtgccatcttctaaaatgatagcctcaatttttccaaatggtcatacatcttctagatttatattaatgtggagatgcatgatatctttcttgttctctgtagcctacattaagaaattgaaatgagacaaaacactaactttgtggtaagctaattacagcagagggaaaaatatatgatcatgtcaggcataggaattaacaaagtttatagatgtattttaaaaattgctatagttctaaaagcttatgtgtctcaaaatatctttttgaaaacttgagctctgagtgaaagaaactaactcacacctttattctcctccttgcctcttaaaatatagaggtcccgtgagcttatttaaagatctttttctctaagttgaaatattcattaatttacattcattgctgcaaattagctagtactttaagtgtaacacttgtttgttttctcagaatttgattacatctgtttagacaaaatcatcacatttacaatactataggttgtgtgaaaacttgattatactccaaaattttcagtttgttaaattctctagagaacaatagtttgtaaatgtaatttgtctgatgcagacttgattagtattccttgtcaatactgactgctttggagactcatgggatttttttctattattcttatgtatgttaaaattttctgttgcctattacacacacacacacctccctttacctgtgattattaatatcgtgaagcctatgctgctatctctgattttaacttatatgttacagttatgtctgcctcctagatatctagataacttgctgtgaggtgtatatatgtatatacatgggacatacttgccttgagtactagtaatgcctcgttattatacacccctctgcaaacacatgacctttttgttatggaagagttttcaacttttgaaagttttgtattaggggaaggaccaaggaaaataaaataagagccagatgaagccaaaaagggtgtgtgtgcatatgggtgttgagtaagagagacagggagatagacagagacagagagattgagacacagaatgagagaaagataatgaaagagtgagaagggttggggtgattttcacaattggataatcagagagaaacaggattgagttaaatgttcctttgtatacatcaattgactcataaagagcattgaaaaatgcaaactggccgggcgcggtggctcacgcctgtaatcccagcactttgggaggccgaggcgggtggatcacgaggtcaggagttcaagaccagcctggccaagatggtgaaatcccgtctttactaaaaatacaaaaattagccgggcgtggtggcgggcacctgtaatcccagctacttggcaggctgaggcagagaattgcttgaacccgggaggcagaggttgcagtgagccaagatcatgccactgcactccagcctgggtgacagagagtgactccgtctcaaaaaaaaaaaaaaaaaaaaaaaaaaaagaatgcaaactaagaattaccaaattatattccttatcttctaccaataataagcattaaaaagtcaaccatatatatttgtgtatagaactgtaatgaagggtataatttgttttctgtagagaactcacctgtggcttagtttttgactcattaaatacagatacattttcaggaaataagaaaattaatgcatctgtattttctttcattttaaaaaaattatccttatagagtaatacaaaaaaagtaatcaaattaatgctgtgtcacagctatacttgttgaagtcgttgtgactaaacaataatagatacagttaatggttgaatagtataactggcagagatgaatactcctctagttaacaaaaatacattttttttgttcttgatgaataccccatatatcaggagcagcaataagcattttcagcgctagagcagacaaaaaatgatgatttatggaactagctgtaggtcttacttagttcgccatgaagactgttttcatagaggatttaaatgaacccagctggcttcgtattctgtgaattgctatagtcgttttctgagtataatcttatgactgattttgtaattctcacagtaggggaaagttgacaacatgaatggcatttagtgaatataattagtaagtctgaaaacaaaggcttttttattctataaaagctctgttcgaaggagattttgaccctgtatgagactgttccaaaaacatagctaccatgactaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggatgcaagtaacctactatgaggaaatataagcttttcagaggctatttagggaaaggatctcaatatttcagatttaagcaactagctagatacacatattaaaacagaatcctctacttagaaacctgtgctgagggaagtggaaaagtattgtaagttatattcaaagacttggggacagatgaacatgcttgattccaaggatatttcatcaatcacagcctggcccattcagatcactttatgcttccaaatttcagctttcaaaaagtgtacgagaaaggctagggttactcgttgatttcttaaagcatcttcttaggactttgtttgttgtattgttattttgttagaagtaaaatgtattcatggccaagagagacttgaacctaacctataatttcttgtagtaactttactgaggtttttaactgacatactataaaatttactcattttaggccaggtgcggtggctcacgccaataatcccagaactttgggaggctaagtcaggcagatcacttgagctcaggagttcgagactggcctaggcaacatggcgaaaccccatctctaccaaaaatagaaaagattagctgagtggggtggtgcgtgcttgtggtcccagctacttgggaggctgaggtgggaggattgcttgagcttgggaggtggaggttgcagtgagccaagatcgcgccactacactccgcctcagagacagagtgagactgttacaagaaaggggtcctgatccagaccccaagagagggttcttggatctcgcacaagaaagaattcagggtgagtctgcagtgcaaagtgaaagaaagtttattaagaaagtaaaagaataaaaaatggctactccatagacagaacagccctgagggctgctggttgcccatttttatggttatttcccgatgatatgctgaacaaggggtggattattcatgcatcccctttttagaccgtataggataacttcctgacattgccatgacatttgtaaattgtcatggcgctggtgggagtgtagcagtgaggacaaccaaaagtcactctcatcgccattttggttttggtgggttttggccggctcctttactgcaacctgctttatcagcaaggtccttatgacctgtattttgtgctcacctcctatctcacctgtgatttcgaatgccttaaccatctgggaatgcaacccagtaggtttcagcctaattttacccagctcctatttaagatggagttgctctggttcacatgcctctgacaagaccccatcttaacaaaaaatttactcactttaggcatacagttagatgaactttgttgtttgtatacagctttggaacctccactgcaatcaaccagtgtggtttcctcatgcccctgtgcagtggatccccactcctagctcgagacaactgctgatttgttttaaatcaccatggtttcgccttcttctagaatttcatatgaatggaatcatacagtaatagagcctttgtgttactttgtgttgttagtgacttttttcacttagtgtaaagttgtggcatgtattggtagttcatttttattttgaggtagtattccattgtatggctgtgccacattttgttcatctgttcatcagctgatggacagttgggttgtttctaaattttctattatacttgttgctatcatcatttatgtataagacataaattcatttatcttgggtaaatacctaggagtgggaatcctgggtcatatggaaagtatagttttaattttaagagagactgtttttcaaagtgtctataccatcttttcttttcttttcttttcttttcttttcttttcttttcttttcttttcttttctttcttttcttttcttttctttcttttcttttctttcctctttcttgtcttgctctgtcacccaggctagagtgtagtggtgcaatctgagctcactgcatcctctgcctcctgggttcaagcaattatcctgcctcagcctcccgagtagctgagactacaggtgcacaccaccgtgcccagctaatttttgtatttttagtagagatgaggtttcaccatatagggcagggtggtctcgaactcctgaccgcgtgatccacccacctcggcctcccagagtgctgggattacaggcatgagccgctgtgcctggccatctaccatttttcattcatacttatgattaaattaaaccacaatgatggatttcatatttggaatatatgaatatatatgaaaagatatctcatattcatgagactggcaaaaaatgttaaattctgttaatataaagtagaggtaagaataaggggcaaagagaactaatggtgagagtataacttgctaaattcattttggaaaacaatttggtactatcaagaaatgttaaaccatgcacagaaatgccccttctagtgtatacactagataaactcttaggtaaggaccctggagacatatacaagaatgatcacataatcaaataacactatcaacagagtgaaaaaaaggcaacccacagaatgggagaatgtattcgtaaataatatatttgataagtgattgatatccgtaatatataaagaactcccacaactcaaccacaacaaaacaactcagttcaaaaatgggtaaacaaattgaataaatatttctccagagaagataaacagatggccaataaacacaggaaaagatacttaacaccactaatcattaggaaattgcaaatcaaaaccacaatgaaataccacttcaaacatactataatggctactatcaagaaaacagaaagcaacaagtgttggcaaggatgtggagaaatttgaacccttatgcattgctggtgggaatgtaaaatggtgcagccaatgtaggaaatagcatggcagttactacaaaaattaaatggaattaccatatgatccagcaattccacttctgggcatatacataaaagaatcggaagcagggactacagatgattgcataccaaattcatagcagcattattcatagtagccaaaacatggaaacaacccaaatgtccattgagtgatgaatggataaacaaagtgtggcatatatacaatggaatactgttcagcctttaaaaggaatgaaactctggtatatgttatattataatatgaatgaatctccgtgatgttatgctacatgaaataagccatatgaagaaggacaaatactatatattccacttatatgaggtacctagaatagtcaaatttgtagagacaaaaagtctttgtttaccaagggttgggggataaggcagatggggagttaatgtttaatgggtaacagtttcagtataggatgattaaaacgtcctggagatggatagtggtgatggttgcacaacagtgtgaatgcacttaacctcactgaactgtgtgcttaaacatggttaaaggcaagcatggtagcccacacctataatcccagggctttaggagactgaggcaggattgcttgaagccaggagtttgatagcagcccagataatatagcctgtaatctcagcactttgagaggccgaggtgggcgaatcacttgagcccaggattttgagaccagcctgagcaacatggcaaaaccccatctctacagaaaaatacaaaaattagcacggtatggtcgtgggtgcctgtagtcacagctactcgggaggctgaggtacaaggattacctgagcctgggaggttgaggctgcagtgagctgtgatcatgccactgcactccagcctaggttacagtaaaatcctctctcaaaaaaataaataaataaataaaaaagtgttcacagcagcattatctgtaattatatccaaaacagtgattccctcacaaaaaaaaatggaaaccagatattgaaaatgttcgatgagataatatgcctaaaatttataatatttatatggtcaactaatatacagcatggatgaatatagctagaaacatcaacatggttaaatacctcactcttaaacagctgctcttcagtgctgaattctaattacgcttttgtaatattctgtgtcttagaccttcaaagtttttcataaatagctaaaatcactaatgttaagtgccatttaatgccatttattaaaggttaaaacctttaaatgcgatttattatttatctacagtgtatagacagagcgaatgagtcctatggactcttttggtgctagtgacaatctgaagctatgtacataaaaaaaaatattccatctactctcaaacctcatacatataaaacaatttaagtaaaatgctcatgacaataaaagttaaaagttttagttacgtgcttaacccatgtctgagaagaaaccatctaacaccaacaaacattcatacttgtaaactatttctataccaatttaaataatttgatttttattaaaactattctcagaagaatttttatttggtaagccaactatagacaggatgattaaaagcatatgaaagtaccagaacagcttttctttgcatagatatatttcattaattcattctggcctttcctaaaaccagtgagtacaaatgatggttaatttgccactggtcctggcaatgcaggctaatgcacatgcaggtcattctccttggataagtggggctagaagggaaaatgctgagaaggggagcaggaaggacaggaaacagaatttgtcttgtctaagaaacttagcagcacaaatgccctgctggtccggaaggtggcaattgagatgaatccttattccatttaatgttgttacggtttcaagtttcagctctcctttcacagattgctaccataaattaggctaacaagtgtgaaacttttaatttgcttgactatacaattgatattatctgtttccttttggttggaaatatcattataataccaaactaaagggtgtaaaaaagggactatcaggcctacataaaggatgaagacctctttccaccgtaaattacatttggctgaattagtgtcagccctagtcatgtagtgcccagaaaagcatttttggtgacagatttagaaataaagctgggaaaacatgtattaaacctgtccggtcatagctacagaactaatgtctttatggtaattgcaatctttaaaaatacattatctttttcaatgttactgcagtgtgtggtggtattaaagaaagcaataatttgtaaacaacccttggcagagggcacagaacttaattttgtttaaataaaggagactaacattagaattcttgtgctgtatcaagactgacaagcagtagtagctgttttgatatgtgcactggagcattcatgattgcttaaatattaactgttccatgaatatacaaatataatagggaaaaaggaagccatgattaatgaaaattttcactaaaagaaataaagttgaattatatgactgtactggtggtttagatggttttattccattgactcaaccagatctcttcactgagtttcagtatttcttttcaaggacaattatatatgtgtattgtgtgatgttgctatgtgttaggaatgtttccttgacacagaaggattaggcaatttttttttttcctgagtacagcacctgttgataagtttgctgaagttcatgtggccattcatgtaaatccaaaaggaaaggggggagatccaaaagggcttccttcagatactctagagatttgaacttttatctcacatttaagttttaatatgctttaaagatagtcttccgttaatgtgtgcagaaacatttcctttagtgatatccacgctgctttactacttcatttcttatactctttatgcaaaaatcagtttttgtctcagagcagtttacactctacagcaattcatgcaagaaaaccaggtgctcctcccacacattcttgcatgtttccagaagagaactaactgttttgttttttcttttttcttttttttttctttgagacggagtttcgctcttgttgcccaggctggagtgcagtggcaggatcttggctcactgcaacctccacctcccgggttcaagtgattctcctgcctcggcctcccaagttgccaggattacaggcatgtgccaccacgcctagctaattttgtatttttagcggagatggggtttcaccaagttggtcaggctggtctcaaactcctgacctcaagtgatccacccaacttggcctcccaaactgctgagattataggcgtgagccactacgtccggccaagagaactgttttctgtgccactctgcaactgaggtcaggattgctttgggacagggagccaaggtccgctgctttgttcctatataatgtatggtaacatatgaacctagccccattctcactcttggtcttcaacccgaaatgagtatgatgacaaatgaaatgcagtatcagcatatgccagggccatggagcaggaatgaagcttccttccttgattgtcttctttacatacacccaccatagtctgatttcatacatgtaaactgtttggcatagaggtcaagcaaggcattaggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttgaatcctttgcactgtattctaacagtgcttgaaggtcaccaaagattaacatcaagtcagccctaattatttttggcctgtctaaagaatttattcattcaacatttactgaataaaattgatatagtcctcatttttaagcagttcacaatctggtgggtgagactagttgtgtacacaaaattatatattgtggaataagtgctataactagagtatatagaaaccgctataggagaacaaagacagaatttagtagttttgctttgttttgttttgttttgttttgagacagagtcttgctctgtcacccaggctggagtgcagtggcgcaatctcggctcactgcaacctccacctcctgggttcaagcaattctcctgccccagcctcctgagtagctgggattacaggcatgtgccaccatgcccggctaatttttgttttgttttgtttttttgtagagatgggatatcaccatgttggccaggctggtctcaaactcctgacctcaggtgatccgccccaactccttgacctcccaaagtgctgggattagaggcgtgaaccaccacacttggcctagaatttattaattctattcagggaagttgagaaaggcttattactagtaactacgactctcctccctttccacacgcataccatcttcatcacccatgacagttcaatccagtaagtatatcttaaattccaagtgtgcataaattgccgtgctttgttctggcaccaacacctattgagtgtgggaactagatcaaacaacttatgagctctatcttatctataaaagtggcatattcgtaactaactcactgaattgattttaggatttaaaaaaaagcacttatgaaagtgcctgagttataggcacatgatagataggcaacaaatgttggttctcctaccccttaaaagaggaataggatattatcacctgatgaaggaagaacagtatgccgaggtcaggaggaacataagtaaatgggtagaaatcttcacccatttgtgcagtcaggaggaacataagtaaatgggtagaaatcttcacccatttgtgcagtcaacaaatacagatagagtgcctattgtatgctacccacttttctagatgctgagtatataaaagtgaacaaagaagacaagaaaactctgtacttgtgtccagcatagctgaagtgagtgtgggaacttgagagaggataatagctagagataagatcacaacagagtaggagccagagggatttttagtttatagtgatgggaagctaaggtaggctctcaacacttcttatctggatgatgatggtacccatgataacatgctatcttattcaattctgcaaacatgtctgtgaacataggtgcttatctaatgctcattttatagataacaaacctgagacatggagtattcatgtaacttgcccaaggtcatacaagtagtaaatggtagggtcaaggttcggacctggttctgtctgaatccaaaatctatgcttaataattattctgattagaaatttgaattttattacatgagttgtaaagaaccatttactttttttaaggaagggagtgacatgatcatatatatgtttaagaaccataattaggctaaatcatataggataaaatgaagcaaagagaatggaatggttatgaccatcttttcatagtgtattttcacatagctaacacttctgtttaaaatttgagctgccatccttttcctaatgccagttcactctagagttatttccctcattctggacatgatacaacattcttttaatcatcgggacttaaagcttttggagtctttgatttttccctttccctcatcttaatattcactgactaaatcctgtttttccttacaatctctcttgaatttgccctttttttgtcttttctacacataccctagttatcattttaagtatatcagtctttgacatttgccaccaaattattctcctatgtcgtttcttttctatatcattttgtattttctactaaattctaagcttaaggccttaaaagtaccatgcatcatttatctcttatccctggtgttcagcatagtcctcaactcacggtggattaaagaatgtacttctccattcatatttgctttgctcctaacctgcctcccctaaaaaaatgtacagtgctacatttcctgagtgacaaattataactttattctggcattcacttgcacctaactctagcaaatgtgtgttctggaaaagtttggcctttgtagtcaacctctgtgtgtgtggtggggtcatatataaacgcagttatacatatatatatatatatatatatatatatatatgtatagaattaaatttaggagtattgctctatagcccagaaaagttggagtttagagaagaatctgcattcggaaacatttattgactatctagtattttctaacatcctcctaggcaccatggattcaaaaatattaccaaagcaaagtctctagccatgtaagagctcatattgagtgtgagagactactatgttgaaatgtttacagtgaatgaagatggccaaaaaaagttattaattgcttctaagatagagaagtcttcagaaatgacatgggagttgagtagtctgaaatgtgagtaggtattttcttggcggataaaaaggaacaaaaaggaagggcgtccacacagagagagctgttggtgcaaaagcacagtggcatgaaactgcatggtatgtttaagcagttgtaatcaggcagacagcagcaggaggcaggttagaaaggtagacaagggtcagctcaagggagtgtcttgtatgcaaaatcaagaacttttcttttccagcagatgacaggagcctttgcaatggatcttttgaatggactctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgatcaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatataaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccaccactaagacttaggcaatctaggcaactattaattggatatttcatgttaatgtaaaattttaatatgatttcatattaaacagctatcaaatggaaatcaattctatttcttaataaactaactcaaacattttggaaatgacttgtacataatcagattagattactcttgttctaccccaagagatgtgtatatccaactagtacacttagaaaagcaaattattggataaatgtctttaaccagtagaactgatgttcttagttgccttctgtgctgacattgaacaacacgatagggcctgagagagatacaatggctaatgtgtgaatggcatagacttggtaagagagactgaaggcatgatataaagtaattaagcttcaataagtaaaaaatattttccattatattttaatattatatatatatatattttaaataattggtctaaggcctctcacacatagagaaaggtttaaaagaccacccatttgtcgtgatttcctgccagtttgaaccattaaaatggtctctgtgtgtttttttttttaaaaaaaaacaacaaatattgcaatacattaagcagcttgtctcccagaccaactaagatacttctcaacttgacaagacaaacatttggccatgtttgcccatgctttgaagggaatattatgattctaaaagaaatacatgcatagtctgtctaaaagtcttttatcatttcatcaaagatactaatacatttaactgatgttgtgctttatttatctttttaaaatgtaaccattaactcttctaaattttgtaacaaattaaattgttagtggaccagatactgaataaatatttattaataaatacaatttttgaaaattaagcacttataagtatgcatgccaaaaactgaaatgttttttaatacaaaacaatctaacacatgtgacaaagaaaaaaaatcacccataaaattgacatatgagcacagtgctatttttctgtttttatatttcctttccagtgttagccatgtgcgttttattgtaaactataatgtacttgtacaatttgatgtcctaaaaaactaggtgggtttttgttgttttgaattgtgttcttttttaaaaaaaaaaattgtttttgtctccatttatgttatgactccaaagagtccataaaatacataggaatttcctttcctttgggaagatgtacctgcaattttttctaagcacttaatgtttccagaattttaggatttaggtagttagtgaacttctaaggaaaaagaaaatgttaatttcctttttatttggaatatccggcatactcttaaaaacgatgcactttgtaaacacatcacacagtaatcccaggtaaagacctctctttaggaatgtgagcttcccattgattcctctacagctgctatccttacttaaggaaaattgcccttgaggtttgtgttgctttttgttctttcagcttgtccttgagttgtgtcatttctaccttaaagtacttaaaagtgtttagtggatcagcatgataatgtaaaattttaaatatttttcctatgtgggataaagtaatccccgaaattttgaaagaaatcattgtgacctcttgaactatcaacattatgcctcctgtggctgtttggttgtttggaaccttgagactaatatttcttctaagttgtttacatcacattgagatgcaaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatctttggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccattgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagatacgctaaacaccccaatttagtcattacacattctatgcatgtagcaatatatcatatgtaccccataagtatacaaatattatgtatcaataaaaaacttaagaatatatagatatttatatatgtgtatatagcgtgtatatatatatatatattttatatagttatgtagtgagacattcaataatcttgtacactttagccactactgctactgacaaaagtagattgtagagcccagccttttgggttagacactataaatttctttctttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagatggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatatcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatacttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaattttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttgatatctgccatgtttccatgtcatgttagttaccgattagctgtttatccactctgactttttcacgggattaataacaatggaagttctgattaaaggcaatgttataggggaaaatctatggattcattccatagtagtatttcttttttatataaaagaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttatagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacctgaaaaaaaaaattgcatattgtctgctattagtttcattgaaaaatctttgagttttttagtaatctattaaagaaaaatctgtggaacaaaatcctgtttttagagtgtttaacttttacttatagtgacttataggacctaagatgcaagaaagtattaaactaaggtttcctaacagatttaaactttgagttataatctaactttttagaagcacagaatgataatataccaatgtgacaaaatgttagtagaattgaccttacttaaatcttagcagcctgagtaaaactgagtatacatattactacattattttaataaaaatgttaacttgtttgttcagcttggtttggatttttttcatatataggatttcaggccgggcgcggtggctcacgcctgtaatcccagcactttgggaggccgagatgggcggatcacgaggtcaggagatcgagaccatcctggctaacacggtgaaaccccatctctactaaaaatacaaaaaagtagccaggcgtggtcgcgggcacctgtagtcccagctactcaggaggctgaggcaggagaatggcgtgaacccaggaggtagaggctgcagtgagccgagatcgcgccaccgcactccagcctgggccacaaagcaagactccatctcaaaaaaaaaaaaaaaaaaaaggacttcaagtaacttaaacaatttttgctgaacgaattgtactctatcaatagcaacaccataaatatgttataaaatttaggggaacgttgttaaatgttagggaatcaaatacatatttatctacataaattttccagtctgtaagacttctttcttcctcactctcaccaagtcagtcctaatttttctaaacaaatgactgtctttaaaataagagaaaaaataagaggtctaaaacagtcacagaatttttttttattattatttttatttttggtaagaacacttaacatgagatctaccctcttaaatttttaagtgtgtaatacattattattgactataattacagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtatctttttaaaggcccactttaaattccaccactctataaaaagcttctccaactattctacctttcaatggcttctcagtttcctccataatactttgaaccttttagctgatcctgtactctcttgcactacagtgtaaaggtttctgtatttatggctgcatactggcatgatgctttctcagttatgtatgatatcattagtctgctttttcaggacaaaatctgtgtcacagtgttacagacaaaatctataacacagtgtcggcataataaattcagctcagtgaatgcttattaaacattaacgtaatccttgttgctttctttattcaaccctacagtgaaattttctgggtgcttggagtaactaaaatatatttgcagatatttaatttcaacttcttacacattaaacaagtagaaaaccatgtcttcaaaaacatattctttaaaagtgattgcttagggcaaaagtagtctatgattttagaattcattataatagttattcttagggtgggttcatgattggaatggaatatgtaggggcttctggggtgttggtcatgttctgtttcttaatcttgatgctagttacatgggtgtgtttagtttctgcagattgattcaggtggccacttatatgcacttttcttaatgtatgttttacttcaaccaagcggtttttaaaagccagtcattcagatttttaatatgtgtaatatgaatagtgaggatggtactacattttaattcagaaggtcctcttgcttttacccatgcttagttatagtgatcacatgcattgtataagtgtaaataggcagctgctgtcagagttaatctgatgttattctaaataattattgttaggaagttgtatgtctcctaaagattttatccaaacaccttttttttttagtctaagagtggataggtgtactttattttaaaaaaagaaagaaaaagagccaccaaccacattatgtaccacgtgaagatcatggtaatctatatcatacttgtcaatattatgctgtcttatatgtcattgaatccttggcacttactgacctaaaatattcaccaataacctgtcgctgctgtcatttttattattttatctttgcttcaatgtcagtaaaaagaatatataggaatattagtcagctttagctcattgtggatttaagcttgttagttaaaaagtgaatattcgtatatcaaatgttctaatttgattgactcctgaagtaaaacacagggacatacttgatacaagaggttgaagtactgatactgagtagtattgtcaaggggggagatgtgagagtaagggaagaaggaagaaagacaaatgaagaaagaactagctttctgctgccacagcagaatcataagaaaagctggatcatgccctgaatggagactcccttgtactactatggaaataggtggaatccaggaatcaacttggttaccattattgtagttttcatcaccaccagtccctctgatatattcatcaataaggatgagcctgcttaagagatgtagggcttagggattggggaggttaccaaacagtatcagagctacctgagcaacaccccacattttccactttttacacgttttgagtgtagcttgaacacaaccaagtcatgggcagtaccattgctgttgtgatttcttgaaattaactggcatcttttgctggaatttggattctacaagttgatgagacaaatttagcaaatataacatttccttgtgccaaagttatatgactcaaactccttaacagtattttcatgtaaaacgatcagaggggaggtggcagttgtagccagttttgcattgccataataaaataccacagattaggtaatttctaaagaaaaaaatttatttcttacagttctggaggctgggaagtccaatatcaaggtgctagtacctagcaagtgccttcttgctctgtcatcccatggcggaagggtggaggggtagaagggtcaatgagcatggatgagagagaaacaagagagagtacaactcgcttttataacaaatctaatcctgtgataacaaatccactcctgtgataaccatattaatccatttttgagggcagagccctcatgacataatcacctcttaaaggccctatttctcaacacctccatggtagggattaattttccaactcatgaactttgggggacacattcaaacaacagcactggcattttaagtttaagattcattgaagtagtgaggagaaaaccctgacttctactggaaactagtagctctgtggcaaaagattctggtatagtcataatctgaaagatgtattcactggaaataatatgtccagggatgagaatcaggacacacacatttgagttccagctttgttaccagctacttttttggacatagtttggccatataacctctcagtgcctatttcctcatttgtacaaaaattttcttaatttgaaaaatagcaatggtaatatctaggctacttatccctcaaggtggttatgcaagtaaaattagatatgcaatatgaaaatgccatatgaaaaaggtgttacatataaaaaattattattcaagctagtatgaggatattaattccagttgattttgattagattttgtttattcagtccagtttaaaaaatgaaggtcagaccaggcgctgtggctcacacctgtaatcccagcactttgggaggccgaggcgggtggattccctgaggtcaggagttcaagacgagcctggccaacatggtgaaacctcgtctctactaaaaatacaaaaaaattagccgggcgaggtggcaggcgcctgtaatcccagctacttgggaggttgaggcaggagaatcacttgaacccgggaggtggaggttgcaatgagccgagattacaccactgcactccagcctgggcaacaagaacgaaactctgtctcaaaaaaacaaaacaaacaaacaaaaaaatgaaggttagaattcacaagttaaaatataaagctttctgaaatgatgtatgattttattaattttagtttttctacatattcttttactcttttccattttggacacttttaaaaataagactaaaaacataatcatgaaggctcatgttattttaaatgacatctctaagctttcatggaagaatcattgtcccccatttaaaggttgatcataaaatttccaatatcctattttgttaggatatctttttccttagcatgtataaacatggaagaaaagataaagcatatagtattaactgaatagcctaagtaattgatagtaaaagtttaggggcaaataaaaaaggtatgaatataaaagattattataataactaataaagatgataaataagtagaaagccaggtcttcaaaaaaattttcttttatgtgcattttaaaggagtagattctgcttgaatttgtagcagaaaacctgaagctaatgtttatgctcggcactgtttcttaattatgcatttgctgatacctaatagtgattatagtaaccactatcatttataaagggctaagtgccaggaattatattaagcatggttttatagaaaaggagactgaggctcagaaacgtgaagtaaagtgcacaagatcacacaatgaataagagcgaatattttttctacttccgtgtctcttgttctttccactataacatggacaataatatcaaaaacataattcaaaaggatataaaatatgaaaattttagttataaatttaatataaactgataaagcagtataaaccttggtaatgtccatattttaatgggaaggtcaattattataattagaaatatctaatcacatcatataaatactgctttgttctaaaacttcagtaaactcttaaatatataaaagtgctatctttagaatttagggttttactcaattgatttttccttctacgtgtccacagagaatagtaacatacattatgatgaggagaaagaataatcatctctgttgcacaccctttttgaggggtgtggtcctcaactaaccacatctttatttaacgctattcgtatgaggaactgcggctgctaaattgttcatttgtatcccttggtttaaatgtgtcagttttcttcagttatctattctctggaagtaagtgtatgctttaaattaatctgtgcacttattcatgtatcttttaccattagaaaacacactgaatagatattcttcggaggaaaatgaattgttgatatctcagcttactcagaaattcagtagaaatgattcttaactcttaaatgggaaaatggcacatggatagaacattttcgtaggaaaaacattccaaacgtatttagcctcaccagtaatggaagaagtgcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctcaaaaaagaaaaaaaaaaaaaatgtggaatattatacagtgttccaggatttagaggacctggaagtatgcaaagatttatcaccttgaaatttatgtgtttttgaatgtatgttattatttttattatttaccttgtgaatctttgctacaataacttgtagtcagaagtctgagaatattggcatccttatgaaaaatgcactgaggaaaacagacaccatttttgcagctttgagactctgctatgtgcgtctcaccatacttcttggtaataaaagtctctttaaaacacactcaaaatacctacttgtaactagcagcttttttttaaagaaggaagactgatgtatatggctgtatttttattatatttgcatgcactgaaatataattattctgaagggaattaaaacaggcaagtgatttcaggaagtggatagagtttaaacatgggacagatcaaatgtataggaaacaagtggtttgtggtaatgattggtgttacatctttcaaggcctgataccattgacatgtggcggtgagcagcatatctctgacacttttgcacagttagcaatgatgttagacagcagttcttcctgaaataagtgagccaaatgccagtgcagctaattggtttacttgggaaatgctattcaccaatataaagcctagaaaagtgaaatttcagtatgcaccttataaactccatcggcatgtagataaccaactaattttgagttacagttggtccagtaccagaagtattgtatggtttatctgaagggactatacagaattcatcactgatatttaaatttttctctatgattgttttatgaaagcagcaaggcaggttatagaattctccgtattgacagatctttaataaataaactttaataaatgaatcaataattggcatagaattaacctccagaaagacacatattgcttagccttaaaagacatttttgaaaaaatgatttacggatacaattttaactctttcattgtactgtcaaaccttattttataattaaaatcctccatgatctggaatctcccttttattaacagtggctaaggagccatagcagtgagactagaaaggagagaaaagattctggaaaatgtgggacttaaatatgtgtgcattgtgacataagtagtggatgagggaaccaccgatggggagaaaaattgcaaaaacaagagtaatatttgtatgcagatatccacctatacaatatatgtgataatttgaaattacctatatctttttttttaaccacacatgattccctgagtagatttcatttctagtatcagcagtgtcatactatgaacgctcaaaagtaaaagttttagaataagctgtaatttcagatccaataatctcagttaaatttggaagaaagtgtcagaggtatttgaaccagagcaactccattttgaatgagggctaggaaaatgaggctgagacttgctgggctgcatggttaagggaacaaattaataatgtttactggccgggcgcggtggctcacgcctgtaatcccagcactttgggagaccgaggtgggcagatcacttgaggttgagacttcaagaccagcctgtccaacatggagaaaccccatctctactaaaaatacaaaattagctgggcatggtgacgcatgcctgtaatcccagctactcgggaggttgaggcaggagaactgcttgaacctagaaggcagaggttgcggtgagccaagatcgtgccattgcactccagcctgggcaacaagagcgaaactccatctcaaaataataataataataatataataataataataataatgattataataatatttactaaacagacccagacttgggagtgtccagatgtcctgatatctggagaacaaaggcattcctaattttgctttaaagataataatatcaattcttgcaaaatatagtaattaagaaagttaatcctgtatcacaaacccttgtagcaaagcacatctccccatatatataagcgttgtacctacggtagatgcattcctcctcttttgggaatgtcctactctgtctatggagtagctgttctttcaccactttactttcttgataaacttgctttaactttggactgcggactcaccttgaattctttcttgcgcaagatccaagaaccctcttttggggtctgcatcgggacccctttcctggaacagaagtacatagaaaggaaatgtttattctgtcagtccagatttcaaaacaaagtgtctagcagaatcaaaccattatcatatttgtattttgtgttctgtctatatttctgttctcaaaactaattatggcatttgatatagttagcgcagaaaagtatacgccgagccttactctgatgttaaatgcttgtggagttcaaatattttgtaaaatactatttacctttctacagatattaatcaaggtagaattacctctctctaaatacagtcttgtctgaagtaaaatcccagtcagtttattatatatcaaaagaagtaaacagcttttttgcttgcttctctaagaaccataatcagttagtcatcttcattctattgccttagtctggtcttccatgatcttaaaaaatgggaaatgactgtgattaatgaagctatttggacgatgatatttaagatgataattgcatttaaatgttatattgtttaaattatatgcaaatatctgagatcaaaggaaacataaagagctctattgtcccataagtagtttccaaattctgctagaaacagttaatatgtttgatcggttctattgtcttgtccagattcttgaattctgtttgtgcaaactggacttgaggggagtatctacagacagagcagcatttctatcactcctcggcagtgttctcttcaacagtgcttattgccagctatcgaaatgtgcagtgtgtgtatgactaagagtggatgagtactgtaacaccttaattacaaaataaatagtgactgtcactgttgctttttatagagctttctgactcaagtgcttggtttcctctgattttttaattatttgcatgaaagaaaaaagaaatcactcctttgacattcgatggagggaaaaggaagagctaattaaactgttgtggaacattattatcctctttagttttacactgacaattctaatgcagagtcactttaaatggctttgcaaatcggaatttgctgggccctttattatttctccaaattcactgaacaagtccattcacagggatattgaaaatgcaaagtaagtccagactgaaatatcatttatttcatgaaacattcattagcactttcagtagctgaagataaaggaaaaaatgtttcacagggagtcatgagagattaatatatacagatttttaaaaacaaaacacagaagtttgaaaaaccatcaggtattgctttgaaaggaatatagagttatatggattttgaatgtgttgaaaaatggcttaaatgtactgagctattcacagcccttggcttttactttttatgtgagttatatctgaacaaaaattttattatagtcagtgttgttcatgctgctatagttaaggttgtcagcatttccattacaaacccactatttcagttggggttcataactcagctttagaagtcaccctgggctaaaggttggcaaatgccttttcaacctgtggtggtaatgatgggtatgagtgtggttaaatatgtagtaaacatttaaattaacatatattacttcttatgttatgaaatattttaattgaataatatattatggttctctgattatagaaactgtctgaggaatgttagctttgtcagtataattgattcagggttaaagaaaactttttttcaatctaattagtccttgtagccaagaaactctgaacatatcttggagccattagccaaacacttcctgctaccaatgagcgatggcttgtaaaaggcactcagtaatatactaacattactgccaaacaactggttaattctgtccaaagattagtgtgtgccacgaggattgaaaagttaaactgacaagtttgagattttgcatacaaccatagccacatacgcaggtaggtaacagattttttaaaatgaaaatcggtttcttttgaattaatctcatttttctggttataaaattaattatttttcctagttatgaaaattaaaatattttagattacttagtaaaaacggaaaaattaaaacagagtaaagaataaaataaattacctataatttctcaaaccagtaataacgactggtaacatgttgatgaatgtccttctgatctttatattatacataaacacagatatgctacaggactgccagcttcatatgcccactgtgcagcagcagaccaatacactgactgcagggttgcagcagaggagtttaatcacaaggcgccaagcaaggaaatgggaggaattctcaagccttgaatttgtttccttgagggattctgggcaagggtgtttaaggggattcataaaagacgggggcggggcggggtgggggctggaaaatttggtgttgtgatcagtgggggcagggaggatgaaatcataaggatgtgtaactgcttttctccaagagtcagcttcttactgggtccaccagaccagcttgattccctagttttgttgatatgcagaacctcctaaagaagcatctcagacaaaaggcttatcttctcacaatgtctgagattttatctatagaaccggaagagaacagagaatcttgtgacaaaggctatgttatcctggggtggtaagtagaaaccagttacaaggaagtgggccaaagggcaagctggcttaatgattgctgctgcaaacctagttggattttattttattttatcttattattttattttatttttcttaaacaatttcattaaattatcttgggaacagtgtcagatatatatatattgctaaggcatactttctctggctgcccagtatcccactgtatgaaatgtttaacttatcacctactgtcgtggatttcgaaatctggttaatgatttatcttagttaatcttagttactttggaataaaaatctgatgaaacctttcagcagctagagtttgctcaggatcttggtcttaagtctggttttagccatttttaggtatgctagttactgtatcctccaaatgttaataatttataattttgattccaaaaatagattaaacacatagaatttattatatattgatcacagagagataccatataccaaacacttaaattccattggcatggttacatattgaagcttttagtgtaaatggagcagactttaaaaattaataaatttggaacatatggaatgatcatttcctttgaattcttcttattttaacttgaagagcaagggaaaaactttcttgcaaaccacatttttccctttaaggtttttgttttttgtttttttgttttttttttttttttcctccctagggaggatatagtggcgggatgcagccggggactctctgtaggaacagaatattatttaatacagaattccatgatccgaaagacctggatttcaatctcaactctgctttctagttatgtatgtgattttagggaaggtacatgacttatgtgagccttacttttctcttccttatgatgtagataatacttgggtcaatggtgttataaatattagatggattatatataaaaatttacttatttgttgattggcatatagctggttccaattaggtaaaaatgatgaaactatgttatactggacttcaaaagttttttgtgggttttttgtttttttttcttgagaagtctcactctgtcacccaggctggagtgcaatggcacgatattggctcactgcaaccttcacctcctgggctcaagcaatactcctacctcaccctcccaagtagctggacccacaggtacatgatgccacacctggctaatttttttgtatttttggtggagaagggggtttcgccacccagactgggaaaagttaaattgagtttagattcatgcgttaaggctgggaagccattgcctactcctgagcaggagagtgatttaatgaaagtgctattctaggaaaattattccagcactgatatcaaaatatctttaaaaggcaagcagtagctgggggtacattgcttttgtctttctctaaaattcatgattatcaataaaagaagactgtctcattacctctgttttagttaagaagctgccagggttttaccattatgttgcagtttttaatctttaggactcatgttattctttacttctgtaacattatagtctcttcatctgtaatttttataagagatatttggaaccttctcattctgtcctccgaagtttaacttttccttcttgtatgcatctcttagtatctctttattattgctttttatatgacttcttaatagctcttcttagtatttcttcttaatatctcttaatattaccttaatattatcaatttcttgagaattatcttccaatgcactaattctctttttttctccccactaattctctctttacctgtatctagcaatcttttcgaatcatctattaagaagcagtatagtgtggtggttaaaagcaaagacttcgaagccagacttcctagattcaagtcatttctctgccacttactagctgggtaatgctggtctagtttcttaacctctctgtgccacaatttcttcattgtcaaaatggatataagagtagcatctgcctcataggtttattttagtattaaatgagtgatgaatgagtttagaatagtacctgtcatatagtaaattttgaatttttctgtttttattgaggttttattattgtagtatctatatttttcctctcatcccctccccctctcttcttctcacagaatctccctctgttacccaggctggagtgcagtggtgcagtcactgctcattgcagccttgacctcccaggctcaagtgatcctccctgctttcgcctactgagtagctgagactacaggcgtgtgccaccacacccagctaatttttgttttttgtttgtttttggtagagacaggatttcgccatgttgcccaaactggtctcaaactcctgggctcaggtgatccacccgcctcagcctcccaaagtgatggtattacagacatgagccaccgtgttccttttattgatctattcattcttttttttccccgtctatttcttgctttatggtgcccctttctttcttcatttcttagatccttatgaacatatttaaaatattgttgttctgatatttattgtttctaaggtatgaatttcaccctttgttatttctgctgactttgtatcatagtggtttttaatgttcatctgattcgcaatttcttcactgagagctcacctttagcagaagttttctttggaagtttcagatgctctgggttgtagaggtaccatatgggatggtttcaatttttctgtctttcctaaattttaccagtttttacattaatttttatctttctattcttttcctttcttttctttttctttgagacagggtctcgctctgccacccaggctggagtacattggtgcaatcatggctcactgcagcctcgaacccccctggtctcaagagatcctctacccttcagcaactgcccccacccctacctcgccatagtgggggctacaagcacatggcaccacgcctggctgatttttgtatttttttcagagctggggttttgccatcttgcccaggctagtctcgaacttctgggatcaagcaaactgcccaccttgtcctcccaaagtgctaggattataggtgtgagccaccaggcctggcctaagttttcaatacatggtctccacacaggttggtaaggcattgaagtttcacctttatacccatagactgatgtggctaactttttccctgctatctttcaggaagtgactgaagcttttctagacttagttttccagatgagaccacccttccaggctcttagctttgtgcagggatctcagttccagctcctcatgtacaagaagcttgtgacataaattctcttccctatgcagatattaaaactctagtctctatgcttatatttagttccttattcctcttagcctgttgcctttagctccctaacagagctttgactttgaattgctactttctgtctggcccctaggaatttgccattcttaattttgagcttggcttttttctttaagttttatacagaacaatttgactagtagtagcttttcacattaacttattcaccattgtgtttggtagaatattgtcaggaataacaatgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaaaaagaaaagaaaaaaagagtgtgaattgccttaggtaaactgaaattgtcaactctgagccaaaacaatgcatcaaatttagaaatgtatgtcttcttatacattgactttactattttcacatgtgtgacttttaacttttcagataatgtatacctattatcagctttctcagtaaattgtttacatcactgaccattaattcttagaagtccttattgctactttttttggtgttcagaaataaattaaaattctcttctttgttcttttacctagtagtgttttacaactttttgaaacatgaacgatgggttaggattttatacaatgaatgatatgaaagttggcttgaatatatacaccacaaggtttgccgtatggtcctctgtcaaatatctgttctcaagatgccccaaggcatcataaaaacaaaatggaaaactgcaacagaagaccaagaaagaaatattttcaggtaaatggtaaagcagggagatgacacatttcgtgcattgtatttcactctttcaacaactatggattgaatgctgaatttgtgccaggtattttataaactgggcacttgtcatacagtggtgatcaaagtggatgtgatcactaccccttgtcacagtctcataggagagacagacaattaattatatagctctagacttaatatgctaggaaagaaacagagtggatacaataatgggtaataatactatatggtgggtgcagggagagggctccttctgatagtgtgttcagagatagcttctctgaagagtggccatttaggtggggacctaaaggctgagtaagaggttgaagtattttctgttggcagggttagagtttcttgggagacataaaatagtttcaaaagaagcattaccaaaataagagtttttataccttcacctgtgaattatacgcttttgtttgtttgtaaacattttattttacaactctacatactctgatgcaattctgtattttggagttttgtttgtttgtttgtttgtttttgagacagagtctcgctctgtcacctaggctggagtgcagtggcgccatctcggctcactgcaacctctgtcccccgggctcaagggattctcctgcctcagcctcccaagtagctgggactacaggcacgtgccaccatgcccagcaatttttttttttttttgtattgttagtagagacgcattttcattatgttggccaggctggtctcaaactcctgacctcaagtgatcctcccgcctcggcctgagattacaggcatgagccaccatgctcagccctctgatgcaatttgagaataaacaagtatagcaagtataagcaaaaggcacaaggtattctgcatagttaaaagtgcagctgcttaaaaaccatcccgtcttctctactctctctctctctctgtcctcctcctcctctttttttctttctctcatattcgtcttacagaatattaaatctgtttccatattgcttggtcccttccttcatcttaagagagatgttaatactgtgcgttcattgagaataaccaaatggatgttagcattgttctttatttaatcttaagtaaaatattgtttttttcttaaaaaaaatacatttatcaaaatttatcttacccttatcaatctcaatacagttgtctttacattaacttctattagttggctattgtcctatgttttatatattcagtaattatataatatggaacaaaagtaagatatcattgctgaatgctgttttatggaaaaagaaaagcctttggcattaatgtaatatatactcctgttgattaatactttgaatgtctttctgtgagatatatacaataatgcccataaaatgatcaattttgataccattctgatgcattaaagatggtgaaataaatgttttaaaaagactgggagatgcgaatacctattttttgaaagcaggttagaatgtaatgcataaatgggcaaatgaaaataaaagcataaacacatagaactaccagggctgttgaatagtacctgactcaggtctcttccctccagaaagactataaaaaaacttctaggcaaaacagttgtgtttcatattttttaagtgctggttagtaaagactttaaaaaactcattacaaagtatttcatgattacagaagaacatgtaatagatagtatgtaaggtataaagaatagtgataatttaaaatcccacgaacttagcacccagctaaagaaatacaactttatcagtgctctttaatgccctgtctgttctgagatcctgtattcctccccctgctccaaacggaactactatcctgaactctgtgtctgttgtccctttgtttttctttatagttttactgtatattatgtatacataaataatctattgtctacttttcctcagttttgaatctttacataaacagaattgtaaaatatgccttattctgcaattagtttttatttttcactaaatcttgtgtttctgagattaactaatattggtgcatgtatctgaatccaattcctctgccacatagcgtttcattggatgactataccacaatttacttagccattctcctgtcaatgtacttgtggtcgccccctccaccaagtcttttgttaatataaacaaagctgacgagaacaatgttttattttgcttcctgatgcaaatatgcaagagtttcctctagggcgctattctgaaacttttttttttatcttagaacctctttactcacctaagaattgaggataccaggaacttttgtttacatctgttaaatgtatcagtatttattcaattagaaatcaaaacagatcatgttaaagcatcagaatatataagcacacattccattaaccatcaaagcagcggtgggcacttgaaacatgagtggcattggaaagttttgagatagagactctggaaactactgtacactctttcaagaatgagagtacaaaaggcagatttcttagtactattatgaatgtagttttgacctcatggacctgctgaagggacctcagagacctgtagctttcatagaccacacattgagaactattgttccaatacaaatctaaggttagaatcattaggtcattatgtctcttcaattactagataacatcaaatatttttctaaagcagttgtactgtaccaatttataatatcaatagcagaatatataagtacttcctttggtacacattctagccaacatttggtcctgtcaaacttttccatttttgacaatctagtggtttaagatggtgtctcactgtggtttcatgttacatttctgtgatcactaatgagcctcaaaatttgtattggccattaaaaagactgttaggtctttttctgatctttcttttgggttgtttatcctctttaaagaaaattctttcaattagttattgaaatattacagatacaaaccccttgtcacttatatgtcctgcagatatttagaaacagttgtggctagtagtagtattacttttaaaaatgtgccttttaatgaacaaatgaacagaattttaaaattagacagtctttttttttttttttgatggaatctcactctgtcactcatgttggagtgtagtggcatgatcttggctcactgcaacctctgcttcctggtttcaagcgattctcctacctcagcctcccgctgtagctgggattacaggcgggtgccaccactcccagctaatttttttgtatttttagtagtgacggggttttaccatgttggccaggctggtctcgaactcctgacctcaaatgatccgcccgcctcaacctcccaaagcgctggattacaggtgtaagccaccacgcccagcctatatagtcatttttatcagtcatttcctttagcacttagactttttgtattttaagtaaccctttctaccttcagttcatgaagatatttttctgtattttcttttattcattaaaacaacactttttgattacctactactatcagacacagttctaggtagtgtggatatggcagtgaaaaaaatacatttaaaaaaaaaccctagactcttagagcttacattctcgaagtggggaggaaaacaataaacacatatgcaagtatctcttagtctcttcagactactgttacagaatactatagactgggtggcttaaacaacagaaatttatttctcagagatctggaagttgggaagctgcagatcagggtgccagcatggtctggttttggagaaggccctcttcctgttttatgcatggccgcttcttactgtgtcttcacatgtcagagagagcagacaggaagcaagtgctttcatgtctttttataaaaggcttgcatcaggtggttggcaataatgaaaaatgtccagattcttaacgtgaagttaaaaattcacaaattgattagaatccacccttatgatctaattatttcccaaaggccctatccccaaataccatcacactagggactagggtttcaacattggaattttgacaggacattcagtccatagcagcatgattttgtatgaaggatagtgataaatattatgtagaataataacgtcagtgagagtgccaagtggtcagaggtggggttctgtaggacagaacagcaaagcacaaacttcccaaggcaattaatgtacttggagagtttgaggaaaaggatgaagtccagataactagaatggagttagcaagaggaagcgtattaggagatctggttgataacagaaacccagatcacctagggcctcctaggccattttaaaggcttgagcttttactttgagatggtaaggcgatggaaagttttgagaaaagaaatggcaggtttttaaaagatcactctgtctcctggtttgagatagtctatatgcaagcaagggacaaaactaggggaacatgtaggaggttgtttcagtaattgaggcagaaatgatggtggcttgcatcaggtggtggcagtagtgaaaaaatgaccaaattcttgatatattttgaagcttttatttgcaattggccagtcacagtggctcccacctgtaatcccagcactttgagagccaaggtaggcaaattgcttgagctcaggagtttgagactaggctgagcaacatggtgagacctcctctttacaaataattttttaagaaacgaacagggagtggtggcacatgcctgtggtcccagccacttgggaggttgaagtgggaggatcacctgagcctgggaggtcgaggcagcaatgagccgtgatcgtgccactgcatttcagcctgagtgacagaatgagactctgtctcaaaaaaaataagacaaaagtacccaaaacaaacaaacaaagatttgcaaattgattaaatatggtttgtgagaaaaacagagtcaaaaatgagtaattcctttttttgttgttttttgttattttttgacatgagtaactagaaagacaaagttgtcatttagagagatgaggaagattgtaggtggaacaagtttaggtacaagagtaagaagttatttttgaacatggtaattttcttatgtccatgttcaccacatagggacaccaagaaagcagttagatatatgagtctggacttatggggagaagtccaacctggacatgtaaatctgtgaggcattagtgcacatagtctttgaagccattagactggatgagattaccaaaggattgattatagatagaaaagggaaggggcctggtgtgtgatccatgacatactataatgtttagagttctagaagatgaaaaggaaccaacagaggggactaagcaatgaccggagaaataaaatggtatttaaatcatatcctgcaagccatctgataaaagtcttttgtaaagagagtgatgaaatttcttaaataaaatgaagtcaagtgaaatgaagacagataattaaacatgaggtctgacaacatgagcctgacaagtcctgtttggatatagtgttggggcaaagaacaagattggaggagattgaagagagaagggaggaattggtaataagaagtattttcttctaaagctcttaaattttcaacatgttctttaaatacattgctttttacctgttacaaaagtaatagtgttcattgtagataatttaggaaaaacttaagaaaatattttatatggtccaaaaaactaactataaccactgtagatattttggtttatagcattggagtccatttttttctgtgcatttttataaattcattttctaaacaaaaaatacattatagacatatttacatgattttcttttttaaaaaattatttatttatttatttatttttttgagatggagtctcgctctgttatttaagctggagtgcagtggtgcgatcttagctcactgcaacctctgcctccccggttcaagcaattctcctgcctcagccccacgagtagctggaattacaggcacgcaccaccacacccggctaattgtattttcagcagagcccgggtttcaccatattggccaagctggtcttgaactgctgacctcaggcaatccacccgcctcggcctcccaaagtgctgggattacaggcgtaagccaccgtacctggcctatttacatgattttctcacgtaagaatgtaccatgtttgtctttccttagtatttttaatggtagtgtagcgttatattatgtattacggtttatatgtagccaatatcctattattaggcacttttcaacattttcttttagaaacattgcagtgagcatttcaatatgtaattatagtctttcattagcatattcttaaagattttgacaattagcccactgggatatgtccagaagagaaatactctgataatggtcggtctgcaaaccttatcatacatacagagggcttaggaatagttgtccacgttgcaaaaattgtaagggttcagtggaagaggaaagctgcccagcagcagaaggtagtccttatagggaagggcagttctctgacagaagaggccttgtccatagaaaagatatgggtagaattgcagcagttgtttgtatgtgcagcagttttttaaataagaaactttccgggctgggcgcggtggctcacacctgtaatcccagcactttgggaggccgcgacgggcggatcacaaggtcaggagatcgagaccatcctggctaacacagtgaaaccccgtctctactaaaaatacaaaaaatcagccaggcgttggggcgggcgcctgtagtcccagctactcgggaggctgaggcaggagaatggcgtgaacccgggaggcggagcttgcagtgagccgagatcgcgccactgcactccagcccgggcaacagagcaagactccgtctcaaaaaaaaaaaaagagtaactttccatattttattgaattgtaggtcatgtaacgaaggttttccatatatctcataggcacaaatataaacattgtatgcattctaaaatcaaataaacacaatctcatttatatatgtctatgcatgtctgtgttgtagttgaggaactttagtttatatgttatactaatagtttactgaatataagtttgaaatatttttctagaattaaggagtatttttaaatcaacttagaattctattttctgcaataggaatatgacaaacattttctcttttttgaccataaactacttgaaccctgtagttttccatttagcttactattttaaggaatgtgataaatcaattgcgaacctttttgttttctttttcttgaggcttctgttgtgatttccagcaaaaaggtcgatgtagacggcattttacctgatgttgatgttgcttgggatcagaattgacaatcaggagtagtctctcagtttagatttacaaaaggccagataacttggatatcactactgcttatagaaacatctctatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatttttggccttttgattgagtattcacaaatcataagtgttccgcttaggagtacttttaaaaagtgaaaaaagggctggacctggtggctcagacctgtaatctcagtactctgggaggccaaggtaggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattataatatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagggctgttctccccttagaggatagtaacttaggactatatcagttacgtctggtaacgatatgccatgtctgtgatactagcatgcatttctataaggaaggaagagatggagggagagaggaatttgttttgaatactctgaaaatgtctagccagtggattataattaccataatcacagtttttggccatttggatgaaagaatgttgttcatgcccatactgctagctaagacagtcatgtgcatactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatacgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcctgcctcagcctcccgagtagctgggactacaggcacctgccaccatgcccggctaattttttgtatttttagtagagtcagggtttcaccgtgttggccaggatggtcttgatctcctgacctcgtgatccgcctgcctcggcctcccaaagtgctgggattacaggcgtgagccaccgcgcctggccgaagtattggttttaagacctctgcagattccgaaattcgtggatgctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgagtgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgatattgatggttattattactaatttttaaagactagtatactcctagcttttcaagacaatgatgaagcaatcctgtacctgtgacaggcctatatttctctttttttttttttttttttttttttttgagacagagtctcgctctgttgcccaggctggagtgcagtggcacaatctcagctcactgcaagctccacctcccgagttcaagcaattctcctgcctcagcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttgacatcccagcctccaaaagtgtgagaaatgattttctgttgtttacaaattacgcagtctgtggtatactgtattagcagcacaaaaatactaagacaaccatcctatgctttagattaaccagtatttaccatataacttgtaaatcggtgttagtggtggtaatgggattactaatgtgcatgtgttaacatgttcattggttcaatgcgaggctgtgatcctgtactctgagtgtgccttttttttttttttttttaattactttaagttccgggatatatgtgcagaacatgcaggtttgttacataggtatacatgtgccatggtggtttgctgcacctattaacccatcatctaggttccctcccctcacctccccaacaagcccgtgtgtgatgttcccctccctgtgtccatgagttctcattgttcagctcccacttatgagtgagaacatgtggtgtttggttttctgttcctgtgttagtttgctgaggatggtggcttccagcttcatccatgtccctgcaaaggacatgacctcatttctttttacggctgcatagtattccatgatgtatatgtaccacattttctttatccattctctcatcgatgggcatttggtttggttccttgtctttgctattgtaaatagtgctgcagtaaacatatgtgtgcatgtgtctttatggtagaatgatttatattcctttggatatatgcctagtgtattagtacattttcatgctgctgatgaagacatacccaagactgggaagaaaaagaggtttatttgaacttagagttccacatggctggggaggcctcagaatcatcacaggcactttctgcatggcagcagcaagagaaaatgagaaagatacaaaagtggaaaacccctgataaaaccaacagatcttgtgagacttattcactaccatgagaacagtatgggggaaaccacccccatgattcaaattatctcccaccaggtccctcccataatacatgggaattatgggactagaattcaagatgagatttaggtggggacacagagccaaaccatatcacccagtattgggattgctgggtcaaatggtatttctggttctagatccttgaggaatcagcacactgtctttcacaacggttgaactaatttacattcccaccaacagtgtaaaagcattcctatttctccatagccttgccaacatctgttgttttgatttgcatttctctaattatcagtggtgttgagctttttttcacatgtttgttggccgcataaatgtcttctattaagaactgtctgttcatatcctttgcccagtttttgatggggttgtttgtttttttcttgtaaattccttgaagtttcttgtagattctggatatcagacctttgtcacatgggtagattgcaaaaattttctcccgttctgtaggttacatgtttactctgatgctagtttcttttgctgtgcagaagctctttagtttaattagatcccctttgttcattttggcttttgttgccattgcttttggtggttttgtcatgaaatctttgcccatgcctatgtcctgaatggtattgcctaggttttcttctagggtttttatggttttgggtttcacacttaagtctttaatccatcttgagttaatttttgtataaggtgtaaggaaggggtccaattttagttttctgcatatggctagccaggtttcccagcaccatttattaaatagggaatcatttccccattgcttgtttttgtcaggtttgtcgaagatcatatcgttgtaaatgtgtgttgttatttttgaggtctgtgttctgttccattggtgtatatgtctgctttggtaccagtaccatgctgttttggttactgtagccttatagtatagtttgaagtcaggtaccatgatgcttccagctttgttctttttgcttaggattgtcttagctatatgggctcttttttggttccatatgaaatttaaagtagttttttctaattctatgaagaatgtcaatggcagttttgttgttgttgttgttgttgttgttgtttttgatgggttcttgctctgttgctcagactggagtgcagtggtgtgatctcggctcaccacgtcctctgcctcctgggttcaagtgattctcttgtttcagcctcccgagtggggattacaggcatgtgccaccatgcctgggtaatttttgtatttttagtagagatggatttttgacatgttggccaggctagttagtctcgaactcctgacctcaagtgatctgctggcctcggcctcccaacatactgtgattacaggcatgaaccactgtgctaaatatgtatctaaggtggcatgagtatatgtgttgttgttgttgttgttgttttgtttctttgagacggagttttgctcttgttgcccaggctggagtgcaatggtacaatcttggctcaccgcaacctccgtctcccaggttcaagccattctcctgcctcagcctccggagtagctgggattacaggcatgcgccaccaccccagctaattttgtatttttagtagagatggggttttgccatgttggtcaggctggtcttgaactcccgacctcaggtgatccacccgcctcggcctcccaaagtgctgggattacaggcgtgagccaccacgcccggcctagagtgtgtgtttttaacaaaggccttccttgccacatcctcattccagtcctagtttagttaatgtgacaatagtagtcttttgcaagataaagattataagtaggtaaccattttagcatttgatgcactttacagattgcaagcaataatatgctataaatttagtttttataataagatcatggtgtgttaatagatcatattctgtaggatagttatagaaagtttttaagtactcttttaaggccaagattcatcaaccatttgcttatcctctcactatttgctgtaatttgtcagtatccttcacaataaaaatagattatgacataccttgggggttcagtgaaggttaggacaagttagggatccaggtaaagcttcagagaggtgatgtaatccccttgatgagattccagtagattaagatcttagtatggcttgtgggggctaggcatgataggaggaagagaagaggttggaattctaggtagaaaaaaacaattaaactgagatataaggtaaagaaagtacagagtaaagtacagagtaaatttgaggagcaataagtagtccatcttggctgaagcataggatatgtgtatagtactgagagaaatcctgtggtggaagaagtttgagactatatcataatggcctcgaatgccatgttaaggattttcaattttatttagaaggctgaggggagaggattgaagaattttgagtagcagaggaattttatcaagaggttgttttgtgatgattgataggaatcatcatcatcatgatatgaataaaatggatagagtaaaaattgaaggtggaccccacttattattaggttactgcagtagtccatgaaagaagaacctaaaccagagtagatgcaactgacattaggaagaaagactcaacagtaatttatatttttatgtggccaggatatgatcaaagacaattctgagcctgaataacttgctgaatagggatgcattttttgccttttttaaaaagaggagagcagtagattcagagaaaggttcctggcttggggagaaattatttttgaacttctctggtttgaagtatacattgagtatatagctagagttgcttaatagggagatgaacatatggtactagaattagaagaagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgtataatacccctgagaggtaaatgtccaatgacatggaattccttactttgtctgggctcctgctgcattgaaaatatattctttgtacttggctggatgcggtggctcacgcatgtaatcccagcactttgggaggccgaggcaggtggatcatttgaggtcagaaatttgagaccagcctgaccaacatggtgaaaccctgtctctactaaaaatatttaaaaaaacaaaaaaaaagaaaaaatgacccaggattataggcacccgtcaccaatcccagctactcatgaggctgaggcacgagaatcgcctgaacccaagagacagagattgcagtgagccaaaattgcaccactgcactctgggagacagagtgagaccctgtctcaaaaaaaaaaaaatatatatatatatatatgtgtatatatatatatgtatatatatatgtgtgtatatatatatgtatatatatatgtatatatatatgtgtatatatatatatatgtatatatatatgtatatatatatgtgtatatatatatgtgtgtgtatatatatatatatacacatatatatatatatatatatatatatatatatatatatatatatatctcacttcttcatactgaattgagatctgtcctcctgtcagctctcactcagttccaccatgggggcaatacagaatctgagatttatctcttcctcatgacagttatttaaatatttgaagcactttccattttgtttacttttctaaagtacttttctatggtacctatgcatactttgttaaccatttcttgattgctgactcctccagaatgttggttattctctcttacttattataatttgtcaatgccccttctaaaatgtcatatgttatttaacctaatgcttcaaataaagttttacctttgcatgatacaattgaacaatgccttatacattgtaggttcaaaggtcaaatctttgaagtataggttcccatcctaaattattgatgacagttttttagcttttatagtaattgcatcttgctgtgaatgcatgttgactctgtggtcaacgaaaaacctcattcctttttttcttttatttttataaacacaaactgcagtcaagttagattatcccaaatcccggacctatataaatgatttaaaaaaaactaattgtaagattttcatttatccctgataaatttaatttttgtttggtttcagttcagcactgctacccattacaaaattttgaatcctgactctatcatctagcatattcgcagtccctttgggttttgtgtcatttgtaaatttaacaagtataccttcaaacagcttcttttaagtcactgatttttttgaaaaaggaacaagaaatgcctgcaactaactaccataaacctcctactggttgacaccaatctaattattaatagccttttaatttaatttttaaaccaaattaaaatctacccacctgtactaatatccagttcttatgcgtgttcctttcccacaatggtatccacagagaatttacccaaaataaaaatatgttatgcatttactttccagttgattttctctaagaaacagttgccagtagtttggcatcagttattttacataatccatgctacttcttgatttttagcatgatgatttataaatttatgaagactttgggcatacccaagcatgaggcagagttgggagtgcttcattttctttaacacaattgagaaaagttgatatttttatcaagacatttgttaaggaagaaacagggaaggtataagaaatctaaataaactggcttgcatactacaggattctaatctccctctagctaatgcagcctacagggcctagcccattccacatagagacctatggaaagtgaggggctttgccttgactcctcatttccactattttggtctgcttccatgttttgagtgtcatttgatacacatcatccaagataatcagtctggattttatgactgttgaatatagtacaagaaaagttatgtccttttgcctgtttacgtaaggaccactctcttaattcctgtttctagaatgaaagaaatgccttttctcaagttgattgttaccaggaatgacttcatattgtttgcgagattccactctatccatatgcttgtggccttttcccatacagagtcaatagtatagtaacttaatacaacctactatcatggaattcatttagtaggaattatcagtttgtaataacagggaatatgggcacaaattgccacttattctggagaaagtgatgagaatgtattagaggaaggagtagggatttagggattgaagactaattaagtagcctttttttttttttttttttttttgcaactgtctctctctgttgcccaggctggagtgcagtggtgctcactgcaacctctgtctcccgggttcaagtgattctccaacctcaacctccctagtagctgagacaacaggagtacaccaccatgcccagctaatttttgtatttttagtagagacaaggtttcaccatgtttgtcagactggtcttgaactcctggcctcaagtgatctgcctgcctcggcctcccaaagtgctgggattacaggcgtgagccaccatgcctggcctaagtacctatattatcttccatatgaaatgtgatgagtaccttaactagtttgtagcaatgtgattgaattatagacagttcgctggtaaaaataggcaaatgataaaatataagagactggggaatataataatcaatataagtaaggagtttttggaaatcaaaaattaagagaactaaagtgtttgtgttacacttgggatcatataaacagaatgctaatgaatgaattgtaggtttttaagggttattttccaaacttagcaaggtaattaacatatcatgctaatacaaatattaatagaaatatagatatactttgagcagcctgcagcctacacctactttcctagagctattgaggttggagagcaaggtgaaaatgatgggtttagatttagttctggattactctgggtgaagattttaagcatgtagttagaagttttacctggagagatatttggaagttgccaaaaagataataggtaaattcaaagaaaagtctttggagtagaagacgaagattgcagataaaatcttagagaataatgcctacctttaggatggaggttgaaaagaacttgccaagaaagagttacaaaagaaaaggaggataaccaaaatctgtgctttatctcaggagccaagagaagaaagcatttttagaatactagggagtaaaacaacaccatcagtgtccacagagaaattgagaagaataagctgctatcaggcctttaagtttggtggtgacatagttatggagatatttcatagaagaggttgaggagactgggaaaggtagattggaagggctcacttaatagaagcagtagtggaggaagcagaagcaatggaccgtccaatacgaatagtcatgaaggtaaggaaagagctttactgtttcttcttcccatttaactgatagctcagtagataaaaaaggagaacaagataaacttatttgttgaaaaattactagaagtttgttatattgtttaaattgatttcaacttcagactgtttaataataagtacatagtttaaccaccataggaatgaatttgagttctttgctctgtataactttaataacagacagatgttagtctttcagcaaagaaacaaaggttgttccctaaattactttagatttacaatgcaatagagcattttaattacattcatatgtgcagacttttaaaaaataatttttaaatggtttattatggtaatagaagcacatttatgccacatcatgcaacacggaaagcatattctctctgttgagtggtgtaaaatgtttgtggcttttgcatctcacatttcttgctttagaagtgctactgtcatttacattctctagtaatccaattgtgaattttatggatatatatgagcatgtgaggacagggtgccagtggaaagctaagaaaaggagaaaggtaaataacagccagagaagttggcaagattactttttcttcaccgtgccaagacagctattttagctgaaaatgaggaggatgggaggtgcacaggaatttagttagatatagaaagagaaaagctgggcaaataattcaggtatgtaagcaagttcaagagatgaatgaagacattattctgatgtctgaagagcggaggttaaaggaaaggttgactaaccaaaaagccttatgtgaacccagggtaatcaataactgcgcttgattagaggtcttgtagcagtggtatatagaagaacagaagaaagatgtggcccccaaggtcgtatttaccagagagaacagtctgagaaacaagccacaaaagaattggtctatgaagcttttctcagaatcagtcgtccccccccctccctccctcccaccctccctcttcccttgctaagtaatggctggacactacagaagtactgtatattcctgggtttatcttaggatatggatagtgaattacaaatgatattttaacccatctattgccattgatatgtaaaaccattttctttattaaaaattgccaatccctatgtccaatattataaaattaatgtctctactaaatgaagaaaaaggttaaaaaataagaagcaatttttaaaaaatccctctttttgcctagccaaaaagaaaaagaaaacaaaaagtgagtaggatttattgtgagaaaatgtaacctttaaagctggcatgctgtttgagttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctcttggtttctaggtttctcgtcacttgcttcaccactgatgatctgctctgtttttcaaccaaattctttgtgaattcatggcattggtagccccattctttgtgtttgtacaatgcactagtctccagagtgtgcattccttgaatgatagaggtttttagttatagtggcatgggccatcactagggtagatgaacagatttgtgattctaggatattacgccagtccagattgggaaaagttttcaaaggtttaaaggtttttctgcgggctgcctttgtttcagcagagtggagagaatttaaaaacatgtacccttaataggaccaatagagtttaaactatatattgtgtaacttttagaaacttttcaaagtacatatcttagcaacttcagaaggatgacataagggtcagcctcactggggatgctgtcccatgttgctccttagttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccatttcaaaaaaaaaaaaaaaaaaaaattcataggtactggactctagaaggtgaatcactgccagtccttcccccagttcattatctgaagtcacaaggcaaagttctttctcctaatcccataaagtcctcgtcctttccccacctaattctgtgtgcagtagccccctctttcaaatgctaagtggacctgactctcatacagagaaataaaaacgggctgggcgcagtggttcacgcctgtaatcccagcactttgagaggcccaggcaggcggatcacctgaggtcaggagttcaagaccattctgaccaacctggtgaaaccctgtcgttactaaaaatacaaaattagctgggcttggtggctcatgactgtaatcccagctacttgggaggctgaggcaggagaatcgcttgaacctgggaggcagaggttgccgtgagccaagatcatgccattgcactccagcctgggcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgtaaagcaagagagtatctaaataggagttgagccatagaatgtaagagctagatgcgcccttagattccatttgctaaaacactgttctgtgaaccagtgttaacctgtgaagttttcatcagcctgtaaatgataatttaaaacacacagaaatttaagctcaatgtattcagtataaagaactactcctttattctgagattatttcttttacatattttttcatgataaaatatcctacttttatgagatgacggtgatgatagatggtaggaattttcctcttaaaataatagcctaatttggcagtataaaaagtgcctcccgattttttgcagtttctgaaaccctaacacctgagaacaactggtctagtttgatctccttatttcatatttgagaaaagtaaggcctaggagaagttaagagagttacttaagactcactactaagaaatcatggaattaaaactagaacctacacattcatattcctagtccacagctctgaataaagcaacaaattccctctctttttcctaaataatacattatttctttctttttctttttcttttcttttttttttttttttttgagacagggtctctctctgtcgcccaggctggagtgcagtggtgccatcttggcccactgcagcctcgacctcctgggctcaagcgattctcccacctcagcctccttagtagctgggaccacaggtgctcgccaccatgcctggctaattttttgcattttttgtagagattgggtttcaccatgttggccaggctggcctcaaactcctgagctcaagcaatcctcccgcctcagtctcccagtatattgggattacaggcataagccaccgtgcccagcccacatttctattcttaaattaacttgaactttgtcaattttatttttcttcttttaccagatttatacttcctatattttgatgtgccagtacttcattgggttaccttcattatgcagttaatttagtttctcaagcacattttaattattgatttctcttattttattaaagtgaattaaaggtacatttgtcttgccaaaaatttaaggccttttattgtccttgtactaagactaagttatctcccagttggtatcatttaataaagacattgattgcattctacttggttgcattctactggtgctggaaaagcgatttcattttctggtgaagtttatgctgacaagttgaatggaaaatatacttgtataatacttttaattacatgttatatgcatttatttattttgctctttagcaggattttagcatcctcacaaaatattatatgactcaaggaactacctactcactttgctttctctgctggaagtaggcaatcaagccaattggaaaatttaaatccgtggattatgggttctaatttctggcctataaataagttagttttgtcataatattatatatttgtataatactttatataataaacacttctttatttctttttggtattcagtgtatcttttacatacattgtcaggctttgttttttctgaaaacactgtgaggacatatttgctcactctcattttgtggatgacagactgaagctcagatgccttaagtaatgtgcccaaaacagcagaactagctaataagtcgcagagtcagatttagaacctcaggtcatatgactacaagtcttgcatttgctccatatctctgctctacggtaatgtttctctttgcatattagtattaaaaatggcttctcccttccctaccagataatggtatgattcttagtaaaacatcccatttccattttaatatcctagaaatttttttttttttttttgacggagtcttgctctgttgcccaggctggagtgcagtggcgtgatcttggctcactgcacgctccgcctcccgggttcaagccattctcctgcctcagcctcccgagtagctgggactacaggcacccgccaccaagcccggctaatttctttttgtatttttagtagagacggggtttcactgtgttagccaggatggtctcgatctcccgacctcgtgatccgcccaccttggcctcccaaagtgctgggattacaggcgtgaaccactgcacccggcccctagaaatattttcaaattgttgaatttgttttagtgatttcacctgtccagataacctaccttaaacatcatgatgagaggggaggggagaaaataaatagtattgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcggttttttttttttttgagatggagttttgcttttgttgcccaggctggagtgcagtggtgtgattttggctcactgcaacctccgcctgccgggttcaagcgattttcctgcctcagcctcccaaatagctgagattacagacatgtgccaccacgcctgactaattttgtatttttagtggaaatggggtttcaccatgttggtcagactggtcttgaattcctgacctcaagtgatccacccgcctcagcctcccaaaatgctgggattacaggtgttaggaagttttgaggaaatacataaaaaacaataatgtgtaactggtaaaagaaaattaaatgaaaggtaaatacaagtgaaggccagttcttgttctgccattgcctggctgctgtactcactatactcatatactatctctattccctctcatgtgccaaaagaaaaatggtaacttaattcataaatttatagtgaggactaattgtgttccccatgagatgtgttctgagtcacatggaaggttatctgtacattcatgtacataagtatatacacatatagacacaaatcataaacagaacttcctaatactaaagaaattatgtgcttacattttctatatatgcctcattttaagaatagtgcaaattcgaatatcttaggaccataagaaggagaaacactgtgtgattcttcatctcatataaggtagagtgtaagttattcttataaacttccttcagacatctaacaatcgatcacatatgtaagaaatttagttagcctattttactggaagataattctatagtagttcctgagctatatctgcattttaaagtatatttactgtgccttgcttactatagatgacatttgtttcagttctcttgtttaccaggggcatggtagggtgatatttatatatttgatttgcagaattagtagcttcagcttaacaaatggctgctcttcagccttttcccaaggttaagtttgaagtgttcaggtcattttatgattttccttgaccacaaccacgttggctgtcaagggctaagattttactaatttgaccaggttgttctttaaaaaccagttattttaattcttttctctatttccccagccttgtgtatttccagttgagtaaaaataaatagaaaatgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacataaaaactgataatacatttcttataaaataacttgctttatcatgttgtatagcttaaattgcttttattccatatatgtgtatggaatatgtgtatacatgcatatgtacatgtacacatgtatatgtatatgtgtgtatctgtatctttttattaatatttgccaatggcataattctacactccagtctctcaagcaagcatttatgtaaagcttgatccagggatatttctttctttacatcatgttccttgcttctttgttgaagcaatttctatttttccttcttttctgatctcccgcaatgttctagttcttgtgaaatattagttttctcagcactgaagttgaaaactttccatataccaactgctgttttcagttctgatttcaaccagggcttggtggaggagtagggtagggaaacttcctgaaaccttgttgatattaatagcaacttaatcctttggcttctactcagatttcgatggactgtacattcatgctcttatctttgaatcatctgacactttttcagccatgaagaaatcagaatatttggtctgttgtatttcctttctaagtactttttaaaggttacctacttttaaaagagctagaccaagtatagtaaaagtatacaccttttcattttggggatggaggagccaagatggccaaatagaaacagctccagtctgcagctcccaacgagacaaatgcagaagggaggtacctagttgatctcattgggactgattagacagtgggtgcaacccaaagagagtgagcacaagcaggatggggcgtcgcttctcccaggaaggccaaggagccagggacctccctcccccagccaagggaagcagtgaggggctgtgctacccgccccagatactacgcttttcccacgaatttttgcaatctgcagatcaggagattccctcgtatgcctgcactaccagggccctgggtctcaagcacaaaactgggcagctgtttgggcaggcacccagctagctgcgggagttgtttttgtaccccggcggtgcctggaacaccagcgaaacaggagaaccatctactcccctggaaatgtggctgaagccagggagccaagtggtctcgctcagcaggtcccattcccacggagctcagcaagctaagaaccatctggagtcgagctgggatgatcaagcttggtgatagggagggtcatccgccattactgaggttttagtaggtggttttcccctgacagtgctgagactgacaggtttggactgggcggaattcatcacagcgtggcaaagcggctgtggccagaatgcttctctagattcctactcaggggcggggcctctctgaaggaaatgccacagccccagtcaggggcttacagataaaactctcatcttcctgggacagagcacctgtggggaggggcagctgcaggcgcagcttcagtggacttaatctttcctgcctgccggcttcgaaggcagcagctgatcctgataagggggattcttccagcacagcgcaccagctctggtaaggctcagtctgcctcctcaggtgggtccatgacccccatgcctcctgactgggagagacctcccaacagggcttgacaaatatctcatacaggagagctccagctggcatcaggccggtgcccctctgggatgaaaattccagaggaaggagcagataacagtctttgctgttctgcagcctccactggtgatacccaggtgaacagggtctggagtggatctccagcaaactccagcagaactgcagaagagaggcctgttagaagaaaaactaacagaaagcaacaacagcatcaacaagaaagaccccccccccaaaaaaaaccccatccaaaggtcatcagcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcaaggaagctaagaaccttgataaaaggttagaggaactgctaactagaataaccagtttagagatggacataaatgacctgatggagctgaaaaacacagcacaaaatctttatgaagcatacacaaggatcaatagctgaatcgatcaagcagaagaaaggatatcagagattgaagaccaccttgctgaaattaggtgtgcagacaagattggagaacatagaatgaaaaggaatgaacaaaccctccaagaaatgtggcattatgtgaaaagaccaactatgattgtttggtatacctgaaagtgatggggagaatggaaccaagttggaaaacacacttcaggatattatccaggagaacgtccccaacctagcaagacaggccaacattcaaattcaggaaatacagagaacaccactaagatactccatgagaaggtcaaccccaagacaaataatcatcagattctccaaggttgaaatgaaagaaaaactgttaagggcagccagagagaaaggttaggtcacctacaaagggaagcccatcagactaacagcagatctctctacaggaaccctacaagccagaaaagagtgggagccaatattcaacattcttaaagaattttcatcccagaatttcatatccagccaaactaagcttcataagcgaagtggaaataaaatcctttccagacaagcaaatgctgaggcattttgtcaccatcaggcctgcttttcaagagctcctgaaggaagcactaaatatagaaagggaaaactggtaccagccactacaaaaacgtaccaaaatataaagaccaatgacactatgaagaaactgcatcaactaatgtgcaaaataaccagctagcatcatgatgacaggatcaaattcacacaaaacagtattaaccttaaatgtaaatgggctaaatgccgcaattaaaagacacagacgggcaaattggataaagagtgaagacacatcagtgtgctgtattcaggagacccatctcacatgcaaagacacacataggctcaaaataaagggatggaggagtatttaccaagtaaatggaaagcaaaaaaataaaaaataaaaaataaatagcagggattgcaatcctagtctctgataaaacagacttttaaaccaacaaaggttaaaaaaggtaaaggagggtactacctaatggtatagagatcaatgcaacaagaagagctaactgtcctaaatacatatgcactcaatacaggagcaaccggactcatcaaacaagttctcagagacctataaagaaacttagactcacacacaatgatagtgggagactttaacaccccactgtcaatgtttgacagattaacaagacagaaaattaacaaggatattcaggactcaaactcagctctggatcaagtggacctaatagacatctacagaactcttgacaccaaatcaacagaatatacattcttctcagcacttattctaaaatggaccacataattggaagtaaaacactcctcagcaaatgcaaaacaatggaaatcataacaagtctctcagaccacagtgcaatcaaattagaactcaggattaagaaactcactcaaagtcacacgactacgtggaaatcgtacaacctcctcctgaatgacccctgggtatataacaaaatgaaggcagaaatcaagaagttctttgaaaccaatgagaacaaggagacagtgtaccagaatctctgggacacagctaaagcagtgttaatagggaactttatagcactaagtgcccacatcagaaagatgggaagatcccaaatcaaaaccctaacatcacaattaaaagaactagagaagcaagagcaaacaaattgaaaagctagcagaagacaagaaataactaagatgagagcagaaatgaaggagatagagacacgaaaaacccttcaaaaaaatcaatgaatccaggagctgattttttgaaaagattaacaaaatagatggactgctagccagactaataaagaagaaaagagagaagaatcaaatagacacaataaaaaaagataaaggcgatatcaccactggtcccacagaaatacaaactaccatcagagaatactgtaaacacctctacacaaataaactagaaaatctagaagaaatagataagttcctggacacatacaccctcccaagactaaaccaggaagaagtcgaatccctgaatagaccaataccaagttctgaaattgaggcagtaattaatagcataccaaccaaaaaagccccaaaccagatggattcacagctgaattctaccagaggtacaaagaggagccggtaccattccttctgaaactattccagacaactgaaaaagagggactcctccctaactcatattatgaggccagcacgatcctgataccaaaatgtggcagagacacaacaaaaaaaaggaaacttcaggccaatatccctaatgaacatcaatgcagaaatcctcaataacatattggtaaactgaatccagcagcacatgaaaaagcttatctaccacgatcaagttggcttcatccctgggatgcaaggctggttcaatatatgcaaatcaataaacataatccatcacaaaaatagaaccaatgacaaaagccacatgatcatctcaatagatgcagaaaaggccttcaataaaattcaacgtcatttcatgttaaaaactctcaataaactaggcattgattgaacatatcacaaaatagtaagagctaattatgacaaacccatagccaatatcatactgaatgggcaatagctggaagcattctttttgaaaacctgcacaagacaaggatggcctctctcaccactcctattcgacatagtattggaagttctggccagggcaatcaggcaggagaaagaaataaagggtattcacataggaagagaggaagtcaaattgtctttgtttgcagatgacatgattctatttagaaaaccccatcgtctcagccccaaaactccttaagctgataaacaacttcagcaaagtctcaggatacaaaatcaatgtgcaaaaatcacaagcatttctatacagcaataatagacacacagagagccaaatcatgaatgaactcatattcacaattgctacaaagataataaaatacccaggaatacaacttacaaggaatgtgaaagacgtcttcaaggagaactacaaaccactgctcaaggaaatgagagaagacacaaacaaatgggaaaacagcccatgctcatggataggaagaatcaatattgtcaaaatggccatactgcccaaagtaatgtatggattcagtgctattcccatcaagctaccattgactttcttcacagagttggaaaaaaactactttaaatttcatatggaaccaaaaaagatcctgtatagccaagacaatcctgagcaaaaagaacaaagctggaggcatcacactacctgactttaaactatactacaaggctgtagtaaccaaaacagcatggtacttgtaccaaaacagacatatagaccaatggagcagaacagagacctcacagtgtaaccccacacatctaaaaccatctgatcttcaacaaaactgacaaaaaaaaagcaatggggaaatgattccctatttaataaatgatgcttggaaaactggctagccatatgcagaaaacagaaactggaccccttccttacaccttatacaaaaattaactcaagatgtattaaagacttaaatgtaaatcccaaaaccataaaaactgtagaagaaaacctaagcaataccattcaggacataggcatgggcaaagacttcctgactaaactgccaaaagcgatggcaacaaaagccaaaattgacaaatgggatctaattaaacaaagagcttctgcacagcaaaagaaactagcatcagagtgaataggcaacctacagaatggaagaatatttttgcattctacccatctgacaaaggtctaatatccagaatctacaaggaacttaagcatatttacaagaaaaaaaaaatcaaaaagtaggcaaaggatatgaacagacctttctcaaaagaaatgtggccaacagatacatgaaataaagctcatcataactggtcattagagaaatgcaaaaccacaatgagataccatctcatgccagtcagaatgatgattatttaaaagtcagcaaacaatagatgctggtgaggctgtggagaaataggaattattttacactattggtgggagtgtaaattagttcaaccattgtggaagacagtgtggcgattcctcaaggatccagaaccagaaataccatttgacccagcaatctcattactgggtatacacccaaaggattataaatcattctattataaagacacatgcacaggtatgtttattgcagcactatttacaatagcaaagacctggaaccaacccaaatgcccatcaatgatagaatggataaagaaaatgtgacacatttccaccacagaatactatacagccataaaaaagaatgagatcatgtcctttgcagggacatgaatgaagctgtaagccatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaatacctaatgcatgcagggcataaaacctagatgatgggttgatgagtgcagcaaaccaccatggcacatgtatacctatgtgacaaacctgcacattctgcacatgtatcctggaacttaaagtaaaaacaaaaataaaaaaaattaaaaatgaaagtatacacctttttatcagcattctttaactctgtctcttccaagctacttctaaaaatgacatgttgtaaaaagaccaatttatttaaatattggaatgattgtgaatatagttatcatgaggtcctaaaatgctgtttcattttgattgtggaggttagtagggaaaatggatacttatgtcataggatcttttacgttgaaagacttggatcatacatgaaaacatatatagaggcatacataatgcatataatcagatgatcaatttataatatccttatatcttagccatatctattgtaatgctgaatgataattaaacattcatttagcatttgacacatcttacgctctgctgaggttatgctaaaagaaattttttttaaattgatgaagatagtatgtttgacagaaaaaaatcaatatgagtgtacctatcaaggggcaggcaatgcttttaaaatgctgtgggtcaggaacactcaggcgtatatacttgtgacatattaaaagcatcctttccagtaataatatcgtttggcagaattattttaatggcctgtgatcctgattctataattctattaccaattaccttgactctgctttcaaaagatgctttaagttttagattctggtattctgatctcagtatctcgtagtgacctcctgttatctactcacttgctactgccagtgtcatggaccatgaattgaacctactgttatcttatggaattttggcactctttctaatcaatcctttgtcatgctaacagtatctttattgttgtttttggctaaattaatagctaaactaggtatttgcatgttttgtctaatcgcttatgaagaaagtactttaccaatattgtgaaaaatgttaccagtcgtatagctttaatgccatgtaacaatgtttacagcgttcaattgaagcactttaatattttaaacccaagttagattgaaagtactcattcagcaagcattttagggattttatggacatcttttaagatcgtctgtgggacgtttgtaacaacagtaatcgcaagaatggcgatgatgatgatgatgatggcagctcacatttattaagctcatagtatatgtcagactctattctaaggactttatatgaattaattcatttaatctttaccagaaccttatgaggtaagaaccatccaattttagagatgtaaatactgaggtactaagcagttaagtgacacgcccaaagttagaaaactaggaagtgtcagagccaaaattggacccccactttttttcatgcctctgattgagatagtaagattttgtcttaccttctgcccagtatttgattaataaaccttatggagcttcacaaaagtaatattttcattaagtgttgcttgtcagtcatgatccatatatgcagaggactaaagagtgtgcaatgatgattgatttttgtactgaaattctttcttttattttgtcaaatgaagaaatttgtcacaagagtgaaccggggccaggtgcagcagctcgcgcctataatcccagcactttggaatgccatggtgggtggatcacgaggtcaggagttcgagaccagcctggccaacatggtgaaaccctgtctctactaaaaatagaaaaatttcccaggcatggtggagcacatctcaggaggctgaggcaagagagtcacttgaacctgggaggcagaggttgcagtgagctgagatcatgccattgcactccagcttcagtgacatagtgagactctgtctcccccctgcaagaaagaaaagtgaatcagcatggaaatgaaaacgttctagtgtcttttcttgtaattattttttatatccatccatccatctggaattcactgtgtgtccaatactgtaataagtgataagaatataatagtaaacaagacatggtccctttttcaaaaaacataattgaactcaggaagagaatagaaacccatttatccttgttgattatatattcacctacctgaaggcagattaactctgaaggagtcaaccagttctgcaatttagattgtaagaataaattttgcttcaaaatagaatttaatttgcttaatttgtttcagtctgttttcagattaacttggatctaattaatgcattagctactattagataaggagtgcttttctgtgttcgctacttttgccaaaagggaatgactgacaaaatcctatataaatttaaggtagaaaatagtctattttctgtggcaatatatatttagaaaggaatgtatagactttctgggtgttttgagataataaaatattctaacaaatgttcttacaaaaaatatcttttgagtaggatgctcattctgttggcccagaattaagtggactattatgtaagcctttgcattatttcaatttttatcacttattttttaaacaacattaaggcaacaaaaggatgtttctgatatccctctcccagtaatgtaaggcagcggtgaggggtttttttttggtcattattttaaggttcttttccccagtctttatcaataggtaatgtttataggtcttcatttgcatttattacccttaactttttaaagtatgatactctttctatgttgctacccttactacataatcatttctaattattatgtaatcctgactcaaattgatgtaccaaaatcatcaatcagtcttctatagagcacagagacctcaaacctttcattattaaacataacttaacattttctgtcttcatgtatctttttatctcctccctttgattatttccttttagatgtaccaagatctgtaaacatttttctactcttcaattttctagaaaaattgttttccaggaagattgtatcaatgtatacaatcatcaggaataaataagcatatgagtttcatcacagcctcaaaaacagtagttttatgtattttatgttactttgacttccaaagagggatagcaagaactgctcataaaaacaagcaaatgcccaaattcaataaaatataaaagtaaaaatgagacattttaaaaaattgtgccaatacatataaagtggtaagctttttgttataacttaaattcctatgactctgaatgaaaaatattttccttttttaattaactttgtcacttcatttgtgaatcgacttcatatgtccttcgtctattgattaagatcaaattttaaccctttatgtagcttgaattctttatataacaaatatttgttgcaaatgttttcctattctgtttattttaattacagttaattataattatcaagaattataactatgacttgatatgtttgtatgttgaaatagtaaggtacttattctcacttaatttttaagtgaactaattgttttggaatcatatatattaattgagtctatcggaactgatactctatactaactgcattttattgttaggaccatttataatcctcttcttaatgattttaacggaaatcacttcttttttttatatttataagcatttagtatattaatctgaatgatgaatacaaattctttattattctgtataccttttgcacatctgaaacatagtattataaaataaaaccttagctttcaaagtcattgtctctgttaagggcttgacaatccaaatttggaggtcaacaaataagcattgacttttcactcttctttgtaattatactataataatctcaatttatgtcaaggaagtgtggatgactctaacttttggaaaaacaaattaccaggtagtataaagtgtgcaaaagaaaaacagattaatgtttcaagatattatttgacctcttttacacatcccttactactgttgacacacttgactttgatatatttcttaaatctttctttcagaagtaatcaagttatttaagaggaaacctttcgatgatagtgtttgttatctctgtgttcatctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaatttgcaactttgaagattgcccttgtgtacagggttaatgtcagatttttagtattaaaaagaaacgactaagaaaatcacaaaacagatacctataataaaacaattgtcctaaaggattatcagcctacctccatgtctgataacagggcaagaaaagaaaatctgagaccatttcaatatgtattttgctaatatcttgagattccacctttccatggaatgataaattttagttctaaaatcatttagaattattaatgttatttgagacaatatggtatgctcttctttattgtgccttctattgaaaataaaatatcccttcagcatctaaaatgtcacttgaattaacactgtgcaatagcaataggagtagataaaactgtcagaaaatgactgggcaatgagacaattattgcagtttattttatcaatctttatttcagagcatgtaaaagtaagtaatgattttgagtctccattttgtgggttatttgagaaaaagatatgttagaacctttcggtttgtgtttttggtataatcataagctgcatgatttgcaatgcctgattttggttctaccttgtttaaatagcttagtttatattatattaattttaatgtagcctcaaccaagatcctattcttacctttctcactaaaaaactgtatagtattaaataatgtgaatcttagggttttttgttttttttttttttttttcaaattgtggttgctaaaagatacaagcagtgttgggtgagtcaggtcatccatgggatttagtcatagaaggacctgatttttatttcttcctctgcaagtaaccagttatgtgatattagacatgtttataacttcttgagacattagtctcctcccataaaataactgtaattgtcaaaattgttctatttagggtgttgctaaaattaaatgaggcaatctgcataaaaaccgtgctttttgcatactcaggagtatgtgatttatcacatttatgtagcttttaaaatttgtatgtaagaagtcattggttaaatagttgaagttttggatatttttatcattatacaatcattattatggtttaattttgtatatatgctttaaaggaatggatgatatgtgtagaaaatgcagtttcagtttgtggaacttagaattgtttttaaaatgtggaattcacatgaagatttgataatagatcaatgttctgttctctgtagaaattacatcattatagggaaaggaattgcacttgtttttgttgtttgagtatatgaactttaacaaggcaacctgagactaatttctaagatatgagatgaaaatgtgttaaaataatagacatatttcagactctgacttcagttgaaaacatagatcccatttttatttctccaaaccagaggaggaaagactgcttctttcctatttttttccctttctatgctattcatcatagcctcttaaaaatgcttctgttttcacttgttcccagattaagaaatgtgttttcattgaaatgttaaaatatgcagtgtgtcacattttgggttaatatcatcaagacaaacaactaagccagttctttatttcctgtcaaattgctgttagttaccaaagccaactaaatactattatatgtcatgttttagaattgtgctttgctttatcagatactaagatgcagcatactggtttgcatctcttagcaatgtttccaaaaccgtaactgtattaaatattagtaaagggctgaatgtacttaagcaatatacaaatgtactcttgatttactgtagagaataattttgttaaaatggttgtattttcatttttatagattcaatagataaacagttattaagcatctatatatcagacactttgagagtacagataattttgtgtagtacctgccattcagtatcctacacatagtaagggaaacagaaatctgaagaagtaaattaccatatagcatattcactcatattaatattaacctcagtgctatggagtacagtggacatagcaaccacctctgcctgttcaagtccaggaaatctttactgagcagctggttttaatcttgatctttgaggatgagtaggaaattgcccagtaaaaaagaaagtgtaagggcggggaattgcatgtgcagaaaattggagtaatgaaaggaccctaacatccatatactagggagtagctagttataggggcataaaatcaaatcgctgctacttgataacttgaagaccaatcttctgttctgacattccatagatcaaacttatataattgtctaatttgaaattgtacaattgtataatttgaaaacgacatgttttcagtgaaaagtaagaacaaaaactatttgttttatctgtgtgtgcatgtgtgtatagtgttaaaagttgtaatgtcaacaggtcatggtggcacgcacctctactcccacctactcaggaggctaaggcaggaagactgcctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcctttaaaaaaaaaatgggtcctggctgggcacggtggctcatgccctgtaatcccagcacttttggaggccgaagtgggtggatcacctgaggtcgggagttcaagaccaacctgaccaacatggagaaaccctgtctctactaaaaatacaaaattaggcgggcagggttgcgcatgcctgtaatcccagctactcaggaggctgaggcaggagaattgcttaaacccaggaagcggaggttggggtaagctgagatcgcaccattgtgctccagcctgggcaacaagagcaaaactccgtctcaaattaaaaaaaaaaaaaaaaaaaaaaaaatcctaaattttaaaatgacgattataaacttgagtattgattttctgttttccttgagttagacagagtttttttctgacaataataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggctcaagtgatcttcccgccttggcctcccaaagtgttgagattacaggcatgagccacagcactgggccatattttctttaagaaagcagtatatttttgttaagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcggatcacgaggtcaagagttcaagaccagcctgaccaatatagtgaaaccccgtctctaccaaaaatacaaaaattagctaggcatggtggcaagcgcctgtagtcccagctactcgggaggctgaggcagaagaatcgcttgaacccaggaagcagaggttgcagtgagccgagatcgtgccactgcattccagcctgggcaacagagcgatatgccatctcagaaagaaaaagaaagaaagtaacaacgcaaacttattttttgaaaaagaaatttagaatttcttaaaatttaaagccaagacatgctctaggaatacaaagaagagaactcctaatttctcctgtgaaaatttaggacatgcttttctttttttttttttgagacaagagtctcgctctgtcacccaggctggagtgcaatggagcaatctcgtctcactgcaacctccgcctcccaggttcaagctattctcctgcctcagcctcccaggtggctgggattacaggtgcctgccaccacacacagctaatatttgtatttttagtagagacagggtttcaccatgttgaccagactggtcccaaactcctgacctcaggtgatctgcctgcctcggcctcccaaagtgctgggattataggcatgagccaccgcgcccagccaggacatgcttttcatgtgagatgacatttgagctggttttggaaagtaacactataaaatgcacatgtaatgaacacatatgtaacaagttattggaatgatcttagttgttactgagaaatctcaattatatgcattttattcaactgatttttattaattttagcatcttgatctagtaggaaaaatcaaatactgcctgctaatacaagaaaaaaaaaatcaaaccaaatacagttgtccttttgtatccttggaggaactggttctataactgctggagataccaaaatttgcagatgctcaagtcctgatataaaatggcctaatatttgcatacaatctaagcatatcctcctgtatactttcgacatctgtaggttacttatgatacctaatgcaatgtaaatgccatgtaaatagttgttatattgagttttaaaaatgtgtattattttttattgttttgttatttttattgattttcaaaaatatttttgatctgcagttgtttgaatccatggatatggaacccatggatacagaggcctgaatgtagatattctaacagtaaattttcttatctgtgagatactataactcatacttaaaacaataagttatctgggcccttacaaatacagacctctggtagagagtctttagagaaattattaaaccttcatataatttgttgagtgtaccatgaatatgttttgtgtgtatgaaattagcagagtagcataggctacgttgtggatgaaaaatgttttatgtgcttagcacattcctctgaaagcaagtcatggagaaagaaatataattatttcaatagaaaaaatttaaaactctgctatattttaatattttagtgatttatatgatataagcatacatgcacttacgattttgcttttttatttcttttcacaagattgagaaaatggagcaacacttcactatttttcttatagggataatatgggcaaattaaatgtaaattgttgactctgaagtgaggggattatttttgttgctgtttcagggaaaacataaataaaagaaagtgaatagatgttatttcctactttagaaagtttgaaaagtaaagataaaaaaggaaaattgtacctatatccattaagttttataagtgctataatgttgccatttttttcagaaaatcatattttaaagccacatcttaattcttaggaattctcaggtaaaattataataaaattcattgaataaatatgattaaatacactagcttcacatgttcctttcttcaggactatcaataataaaatagatggaagtacagcgctgaagagaaactaccctggcaaaagtatatgcttacccatagttgtagctttattgttttcccaagatagacttttcatatttctgcaccttcatttttcatcttactcaccaattgcatatcttttatagatgtcagaatgattagatttagcgtctgcaaaatactcatcgttgagaattatagaccacttagaagattggcaaggacaagttaaaactgaaaataggcatctcaacaggcatgcaaaatcatagcagtgattcagtaaattctcagagatatttcccttttgtgataggaatggggggatagtttatattttgagattctttgcagaataaacactgggagcagaaaattacacctatatttattgccaagctgcatttgttatataatgcattttcctcctccctagatgtaccccaccttctgtcaaaatgttatttctttggctattctttgttgcatgtagttcagttcaggcctgactcctaggattctgcaggtttttttgtttgttttttttaacttcccacccagggaagtgaaagttctgttttaaaaattcctgaatgtgtataaatttcattctgacaagcccactttttcagtatgattttatcagtgcttacaagttttagaaaaaaaaaaaaaagaaaaagaaatctcagatgacctttaatgtcataactgaacttgggttttgaggagagcaaagagagcaacaatttgaagatgtaggtttactagtaaacacttctgttccaccatctgctcccccaccaccccatcgcagattacagtggaatgagataccagggtggggccagaggggccgtggtaaaatggggatgaggtgagagcagggaaggtgatgtgggagcagatggcagctggtgaaagaggcactccatggcactgttggcatggttacagagaagtagatgtcctaacatgctgtgccaattttggaatgtttcaaactctactttgtaacttgtggcctcaaactaaactcattggctgtgtagagcttctcctgtgacaagcagttcctataaaagcattagtttagttatattgtctaacggctgcttaaaatatattcgtgtgtgtttgtgcgtgtgttgtaattaatctatggaaatgtaaaaataaagtatttactgtccttggtctccaggtgaataataattactacatattaacaaccctgataataatatatatgtaataatgaaacagttttgctgtaccatctatttgtgtaacaggagcaaatattgttaaaaacagttcattggattttgttgttgttgttgttgctttacatcagtttataaaagtcatatgagcatttgcctgtctcatctttagatgaatttttgttttccattaaacaaaaaaaaaaccgaaatggcctaatttaagttgaactaggtcattgactaaagtcttatttttgtctaaaaatgcatccattgcaaatgttactgccatttctagtgtctacagtgtccttagaggatatgcatagtgagttgatttgaaaagtttttggccatatggcatggttgaagcaaaaacgtattgtgttaggtcaaaccatgtgtaattgctgatgccacacaatttttttaaatataaaatataaaatagcatttttttgtggttcaacctgatatatacatttttaaattccttattctgaatttgggtaaaaataaataataacttataaaacacgtgtatgtatatttggtcttgcagctaaataagattatatataattttccaaatcttcggagagtccagcttaattaaaaatactatttgcacaaatgttgcggtttgtctctgtagaagctctgagagcattcatttaatttattaacccaagtttctcttgctaatacatttactcagaagtaactctgctgtacataaaaatagttgattcaatagagaagtagctaaacaattttttgttgttgttgttaagtaaagggattaattcatgttagtcactggaatgtcttgcttaaaatttcctccaaaattttttgttcaagttttcattacacttttcccgcaatttaacaaaaatgattttgctccttctttttttttttcctgaaactgtttttagaatggaattaactgattctataaagtacacaaatgattggtattaaatgtctgtctctttagtccacaagtgtttagttttttgaacagagatgaaaattgaattgggctttgtaccaaagatttatatttagataaagttattccaatggtattcaaagtgttaattgtatttctacagcaaacttcatcgtattacaccaaagcaaataccatatttgagatgcatctctaccacatttagtcttgttccttcattttgtttatttcattatttgaagtataaagggagggtctagatgatgatgatgatgatgatgatgatgatgatgatgatgatgatgattgagatggagtttcgctcttgttgcccaggctggagtgcagtggcatgatctcagctcgctgcaacctccgcctcccaggttcaagcaattctcctgcctcagcctcccgagtagctgggtttacaggcatgtgccatcatgccaggctaattttgtatttttagtagagacggggtttcaccatggtggccaggctggcctcaaattcctgacctcaggtgatccaccctccttggcctcccaaagtgctgggattacaggcatgagccaccatgcctggcccaagtctagattattgaatagaaaaacatgatcctgaatgacaaaatgtgtctgaccaaagtagatttacccatgcacagaaatcgaagtcaatttttagtgataagaccccatattaaatatgaatcatgtcttggatttctcctaaattcgctttaacatataatgtgacataattgttaaaggaaggtctgaaagtcatataatccgtctttattcattttcatgcttaaactaacacacaatgctagtataatgtgaccctttaattctgagataattttctggagattatagtttggtttgtggtttttgttttgtgttttatttgttttggggatgggatctcacactgttaccaaggctggcatgcagtgggattatcaccactcactgcagcctcaacatgattggatcaagggatcctcctatctcagtctcctcagtagctgggaccatagacctgtgccaccatgcccttaagctaacattttatttatttatttgtagagatggagtctccctatcttgtctaggctggtctcaaactccttggctcaagcaatcctcccaacccagcctcccaaattgttggtattacaggcttgagccactgagcccagcttgttttgtcttaaagtacaaaaggatctcttgtccttaagtgttccttagatctgagtccaaagcaaattttccttttttcataatgtttattttaaatgaagaaatttgactgttatatatatggctcaaatttttactctaatttctagattgtttacctaagtatcctatcactatttgcagattcacttctaactctccctaaatttcaggccactagtagtgtttttcatgttttttcaaataggaatgattcaaatcgacttatatcagcttatggttttttgactgtttttaaccccccaccagtttttgggtagaaaatggtagatcattctataccatttaaattcaaacatttttaatttatcttagtttctgatatgttttcatttactcgattacatatttctgcaaatataattgaatataagtcaaaatatcatttttcataccttttatacttcctgtctctattttttgccttatattttctaattttctatatttctaatttctagggcaattgatatttaataaacattctctattgtgtagtaaagcttgtatttctaccgatttaaattagtaatatcctattagtttaaacaactttaaaccatatctcaacttttcatagttagttgttttggggtcaactatgaatgaatagaagaatctttgtattagcaattcaagaagcagcaattatgtatttctgagttttttgtttttgtttgagtctagttcaaagtagagaaagttattgtttactgtttttttagtttaaaattaaatgaaaaagatggatatgtcttgaatatcaagtggagtagcatgtactcagaaaaagcaaccatttcctgaccaaattagacccttattaacgatagcacatgatgctgtttaatttgtttggggtatgctcttaccccaattgttaattgtcagtttctgaaaataatcagttttcaacatttcacggtttttcaattaggctatggcaacaaatgccattgttgctaattgccagagtttagtcagtaaaattatgatatggtctttctttaactattatcaggtcacttagtatctgcttcatctttttacgctttaataaactaagcagaagattgagatcattagatatccaactgtaatttagcactgtcaagattaaggaggggattatggtcattaggagcaaaatggtttcatttatggactgagaacaatgaggcccatcaataaaccactttctgcctctaatgatcttacttctctctaattgtgtgctaatctaacaacaaactcattttcttctttcattcttgagggaaagattgctaaacagaaatgctttgcatatatgttgcttttacttccttaagttttggtgtgtgttcatgaatgcagtaaattatttctaggtgaacagatatgtctcttaagggaaatatgctatgttctcttctagtttatcaacatatttttgacagaggaatagattttctgtgattagatgtgctttattattagtaccatcttaatccttatttgagtcattcattgtagaaagagatctgtcttataaaattaccaactcaaaatatctaagtgtgctaagaatcgaaaatgatctcagtaaagtgggtcataagggatatatctcttattgggctgtctgccattctatcacctttatgatagaagttctctaaacccacctctttgtagccacattccttgagaaatcaatgcttgcacttcactgaatttaacatgttgactgaggcccaaggcactctgactgtttgcagctagtagaggatccttgagtacaccctggtacttctgctctcaacatttgagattttggcttatcatgaatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagactatagattttttaggcactaagagaaagaagagctaaaacgtgtcattatagtaccacctcccaaatgttacccatatctaatgagtgaatgaaagaatggcccaggaagacttggaagtctgtagttgttattaatggaatgttccttccactgtaaactggagtgtaagattgtaaaaaataaatacggcattaggaattacataatatgacttgaaacatgccaggacttgtttctgaagattgaggaatgagtatacgttttttgttttttgttttttgttttattttgttttgttttgttttgttttgtttgagatggagtctcaccttgttgcccaggctgggtgcaatggcgcgatctcggctcactgcaacctccacctcccaggttcaagtgactctcctgcctcagcctcccgagtagctgggattacaggtgtctgccaccaggcccggccaattttttgtatttctagtagagacaggatttcatcatgttggccaggctggtcttgaactcctgacctcaggtgatccacccgcctcggcctcccacagtgctgggattacaagcatgagccacctcacccagccgagtatatgttttaaagtatgtaatgtaaatactcaggcagtcagtggagtcacaggaaaattccctcaaggactttaatcagcagaaatgtttgtgtatttgtgtgtgtgtatatatatgtatatatgtgtgtatatgtgtatattccagtagttacagttaatgtatatgtcataacaatacagaaaatgttaatattaaaatttatgtcacctttattcattcacctaatataatcagaattgacaaaacatgttagctattcatggcactgaatggagtattctgagcacagtaggaaactcacaaaattggccaggtgcggttgctcatgcctgtaatcccagcagtttgggaggccgaggcaggtggattgcctgaggtcaggagtttaagaccagcctggccaacatggtgaaaccctgtctctactaaaagtatttttaaaaatgagccgggcatggtggcaggtgctggtaatcccagctactcgggaggctgaggcaggagaattgcttgagccgggaggcagaggttacagtgagccgagatcacgccactgcactccagcctgggtgacaaagcaagacttcgtctaaaaaaaaaactcacaaaatcaataaagcaatgtgggtcaacaggatatgtgaatattataaggatatttccctattctattcatttattatttagtacttcacatagtttattcttagctgattagtgattaaaccattagatagtaatatgtttgttcatttcacccaatatatatttactcctactttgtgcaacacaatatactaggcccattgagaagtacaaaatgtaccccttaccttcaaggacgtgacagaaatataacttttttgataaaatgattgcaaaagatttaatcagggtgacactaagagaatgcttttgaagacttatctcaaacaggtcttagtttattccaagtcttacaaagtcaaagttgcataagtcttacaaagtcaaagttgcataagtcttataaagtcagagttgcaaagtgaatagtgaagcaaatcaagaagatttttttagatcatataagaaaaggtaataatcaaaaagtaaaatccagttgctgaatttaggttagttaatataaggcatgattatgtaaaactgactgtaaaattgagatccagtttttaaaaatccaagttatttgtaggcaaatgttaaacaattaaaaaaattttttttcaatatttttgagacaggatcttgctctgtcacccaggttggagtgcagtggcactatatgagctcactgcagcctccacctcccaggttcaagtgatcatctcacctcagcctcccaagtagctgggaccacacgcatgtgccattatgctatgctaatttttaaatttttcatagagccgagctctcactatattggccaggctggtctcgagtttgtgggctcaagcgatccccccgcctcagcctcccaaagtgttgggattacaggcatgagccactgtttctggcccttaaactatatatataattaaatcctgcccctgattttatattagaaaattcagcaggtgcacgcagcaaatcttagggggaaaatggtagttttcctaatacttaaactttagctgcaaatacatgaggccctggatcctaaaatcattggggtcatatgctagattctgtgtgtatggtagaaaatttgaaaatactatttttgtggggagagaattcatatagaaaatgaagtctgttgacgtatggtaagtaagacaggcgaaaaaagtgttttgcaacttcgcttgttgctctgatactactcattagtgtatgctcacttttttctttctaagatcataccctttattaggcagcaatattcttctaatggagaaaagaaaatgagcagtttacaattatgtaaataagacatagttttttctatttctgaaaagtaatagaacttttttcccctaaatgaataaaatctcaaataaaattagaatccctgtacctcactactcattaaagggtgacactagtaacaatttgtaaagaggaaactgtagaaatgcaataaaagaagattatcttagcaaaattgagatttctctctgtatgtcatgctaaaaatgtagctgagagctggtctttgcaagatcaatgtgggatctatgcatgaaatgtgatttgcatatttaaagaaacagtttaaatcatagcttataacccatgccacagagagaaagaagtaatgtaatgctgttgtacccttgtccatctatgtatagctgagtccatgtgtgtgccaaaagggcacaggtgcacttttaattccccagagacaataaggctggtatgtggggtttataaaagcttttccttttcatgttcaccatggcgattgtgactattttttatatttgggatagcactgccatttcccactaatttgtattagttaaatgtgttcaattctaaaaacctcttgattcatgttcaggatgttagtcatattcattagtttctaattgcattctgtaacctatggtagctctggggacttcaaatgtaattgaaggttttaattttaactcattgaatcaagtagtgatatggtgacatcagtgtcttaagaattttttttttctggaagcattatgtgatatggattgaatgcatgtagaacagttgcagtgttccaacctttaggtgagatgcacttcctaaaagtggcaattgcaatgcacagacaaaggtggatgccaaaggcattttgaaaatgattgatgagacttggtgactggctggttatggttaatacaaaagataaagagtaaaagctaactctgtggttttaagcagtgacagctggaagagtagtaatgccactggggaaaacaggataatcagaaacagatctggtttctgggagaaggtggtctgctcaggtttggatatgatgcttatgaagacatgggacactcaattacatgtttaattttatgtgagactagaagaccattcctcaaataaaagattggggtttgggtatagagatttgggcttatatataataacaatataagatttcagcttatatataataagatataatatattgttattatatataataacaatattacatcttattatatataacatattatatattatatataataagatgtaatattgttattatatatgataacaatatataagatttcagcttatatataatagcaaaagccttgatgtaagagcaatgcattaagacagggtttatagagaaaaaaacgcgtttatagagatcttggggaatgcttccatctgaatggtgggaaggagaatagaatgcagcaaatgaaacaaaggaagagctgtcatcttgctctataaaagtatttagcatgaaagagatctctatttggagttaaagcagtattatggtattggcctcaaacaatttttccatgtgtcaagtagtaatttcttttcaaatattgataagaaatcttcacagatattacaataaatgtattcagaattcttatatactgtgggtctgaaatcaaccataattatttttatgagttgacaaaattataataaatgcaaatatcctttgctgtagattagaggcatttttggaaagtttcctatgaaaaatattttccatttactggggttttctttctaaatattccctttatatgtagaaacttaaaaggaaagagccagagatctcttttggctccatcctcctgccaagcacaattttcttattgcagcatttataataccatcaactaaagatttttatattaaaaacattttacaaagagtcacagacccatttgtatgttttgttttgtttttaaacggagtttggctcttgttgcctaggctggagtgcaatggtgcagtctcagctaactgcaacctctgcttcccgggttctagagattctcagcctcccaagtagctgggatgacaggcgcgtgcctccactcctggataattttttgtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggctttttttttttttttttgagtaaattactcttgaaagggttcttattggtaccctctagaggttcagaagagttaattggcttacaaaacatatgtggatcgaacttggggaatagttcagtcatctcttaacatctggatgtactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgccattcacattttgaaaatattaccaattattttaatattatctactttgaaaatatgggaaacaaaattgttcatgatgtttgtgtgcacatcattcaaagaaccaaaacaaaatttttatcaatctgcattccctcagagagataaaatattgctctgtgaaaatctgattttcaccatatgctaatcataccctcttccacagacctcttctcttacttcctcctgaacataaccttccatcaaaacaagaaacaacacaaaaacatcctccaagaaaaaaagaaattacaaaatacaaaagcaattcacaaagccagaaataaatgtttatttagttaaaaaaaataaaaagatgaatgttgatgacttcaccattgaaaatgatgcctcaatatacaacttggcttcaaagatccttagccttgatttggtcatcacgagttattctctccatttcagcttcccccatagcatgtaaacatcagactttgtcatcacatatgacagtgtagctaccaccaagatctcaagctctgaatgtgtccttgtacccacaaccatcctcacatagcccttgcctctggcgcctgtttttctgttgccctcattatgaccttacccttacccttcctcatcttatttatttattgttaagacagagtctcgctctgtcacccaggctggagtgtagtggcgtgatctcagctcactgcagcctccttctcccgggttcaagcgattctcctgtctcagcctcgcaagtagctgggattacaggcgtgtgccgtcacacctggctaatttttgtatttttagtagcgacgggatttcaccatgttggccaggctggtctcgaactcaggtgatctgcctgccttggcttcccaaagtactgagattacaggtgtgagccatcgcacccggcccctctttcttttctcccaaactatttgctcccctcaagctgcatttgccatataacctacacactgtctagcactgtagaatcctcatacttgcttcaagctcccctcctttagccttctgccgtccacaccctgatattcctgttgctctgatccaatcccaactcccgcatacatgacagaagtcacacagtctacctgatgggatccgttgttccatcatttctaaccttagcctcctaatggagttggggtagcttttcatttaactctaattctgtctttttccccacaacagcaattccaaactaggtttgttctcctcaaatccctgagtctagctaccatattcccagataaacatctcttctcattcttgactgaagatgaaaaaatattcttttcatttactgccacatatctcaaagaagacattacatctcctcctgtttacaaattattttcttcctactaactcttcagtgtgttatcatctgactgatactcccatcaatttatacgtctttgtatttggttgtcttaacctccctacaataaagctccatgggggcaaagacagtggtttgttcccctcacttccttgtttgctattgcagtgctatgccattagcagaactatgtgttaactttcagggcctaaaagaacttcagataccaggttcaccttgtacttcccatacttggaaatactgctgaactaaatcttgccttattctcagcaggcagtagagcatgttggttaagaacacacatgagacttcataacttcaaatattgtctctgccacttactagttacatgactttgaagaaattatttaatctctctttgtctcaggtttttcatatgtaaaactggcataataacaagatacgttttataggatgaaatgagtatgtgcatgtgtgtgtgtttgtgtgtctgtttatacaacactgggatttgtaacttggcaacttcctggaatgtactggagtatcattttaaagcccatggtaatgacaaagagatcagttatttaggatgcgttttggtcaattctaaaaggaagctataagatgggataatggagaatttcatttggactcctccgtgttattttcagaagtgataatttggccattgagattgaatttcatgttgctttatagtggctgatttttccttttatactgactgggatacaggacctggctttgagtttctgcatgtgtctgttgcttttatattttatttatttaatttggggatttacaaaataaattttgccagcctgctttgatcatagctgtctgtggcattgtgctaactcaattaaaaagtttttttttctgtcctgttaaattaacattctattgatacattcaacagaataaacttatataatcaattccacattatagaattcacaatatacattttaccctcagaaggatgcaaagaattgttgtaaggagactcagttgcattatggttatagaggcatcaagaaatccagaggcacagtggctcacgcctgtaatcccagcacttagggaggctgaggccggtagatcacatgagatcgggagttcgagaccagcctgaccaacatggagaaaccccgtctctactaaaaatacaaaaaaaaaaaattagccagacatggtggtgcatgcctgtaatcccagctactcgggaggctgaggcaggagaatcgtttgaacctgggaggcggaggttgtgttgagccgagatctcgccattgcactccagcctaggcaacaagagcgaaactccatctcaaaaaaaaaaaaaaaaagaaaaaaagaaatccagaggcctggtggtgtatacctaggcaatccacttttgttttctctctgtttccatatcctcatgagagatctggactaggaaattgctgatatccctccccaagggggcatttttgttaatctagaacatggatcaacaaactttttctgcagagagcaagatattaaatattttagggcttacggaccacacacagtccctgtcacaaggactcaggactgcctttatagtccaaaagcagccataggcaatatgtaaacgatggacctggctgtttttcaataaaactttatttatggacactgaaatttaaatttcatatacttttcatgtgtcacaaaatgctatccttcttttgatttttttttcagccacttaaaaatgtaaaaagcattcttagttcacaggccatacgaaaacaggcagccagctagatatggcctgcagacagtagttcaccaatcccttatctagtctagccaagcaatgtatacatatgtctatttgaggaacttctatattgaagacattatctcatagtacttgtattagtgaacattttcactttcctttcccttgtttcataaatgatcactaggcatttgaatatttcagagcctttagccagattgcatgtgtatttgtgcttgtatatatttttgccagaacacttgaaagtctctgggccttttattcatctttgctttgccaaatattttcccacctgtatagatgaattaaaattttcaacagcctttctttgaacatgacttttgagaccagttgctatttaaattacacaaaagtatatttagcccttctttgtgttttattccctttttgccagggtggaaggacttttcaggaacatatttgaatagatggagaattctgaaaaacataacccagatatttatttgggtctcagagaagaagacgttttgaaaacaacctttgtggctgggcacagtggctcatgcctgtaatcccaacactttgggaggccacggtgggtggatcatgaggtcaggagatggagaccatcctggccaacatggtgaaaccccatctctactcaaaatacaaaaattagccaggcgtggtggcacatgcctgtaatcccagctactcaggaggctgaggcaggagaatggcttgaacctgggaggcagaggttgtggtgagccaagatcgcaccaatgcactccagcctgtgggatagggcgagactacgtcaaaaaaaaaaaaaaaaaaaaaagaaagaaattttatcaatttatcctgcttgaagtctttcagcgctttctcactacacttaaggtgaaacccaaattccttacggtgtcctacaagaccctacctacctctcaaacttcatctcaaatttttttttaaaatccattattttgttagtagacaaaactacataaagtataataaatttatgacatgataatgcccagataactaatcaagacttgctttatttagggactgctttcagtagtgaggaacttaaaaacatagtacaattatattatctaattgctttagtttgtattgccaatttcttatttcagggcatatagtaatcctattaatatccacagttaatgaataaggaaaatacaaccataggcttactatatcctttgaagcatcttttgtctgacctataaccctattacccaggagaaatattgctaatccaggcaacactaatgtggaatggactctaatggcttcaggactatgacctcagcactgatctcaacaacctgcattcagtttgggtgaaaattcgtggctttgtatatgttacatacctgtggacttcatgcattaaacttgttcctcaaaaactctgtgaagtgcaagaatctgcatatagtcctattaatttccctgaagagttcaggaataaagttaatgaaaaatttacccatgatcacaaaaattacactcaacaaggctaacattattttaatacagcattatagctttatggaaacactatttatgtgtacttaattcttgccaaatagtaatgtggaagacagtatctattcaaatggttcatcaatctgtatgatcttttcacaacttattgaagataccatttaccagaagtaagggtatatattagtaaagttttctttttcctttttttttcattttcatttttttttttttttttgagatggagtctcgctctatcgcccaggctggagtgcagtggcacaatctcggctccctgcaagctccacctcccgggttcacgccattctcctgcctcagcctcccgagtagctgggactacaggtgcccgcaaccacgcccggctaattttttgtatttttagtagagatggggtttcaccatgttagccaggatggtctcgatctcctgacctcgtgatccacccgcctcggcctcccaaagtgctgggattacaggcgtgaaccaccgcgcccggcgtgtaaagttttcattaagtgattgctcagataaaagcatttgtgaatgcttattcaagaagcaggtagtcgtcttgttgtgaaacagtgttcatttatcgcatctagtttgtcaaaacattgtttgacagtattgaatataaattgttttctacctgtttgttcttcgtgacctttttgcagtactatttactcaattattgtagttcacaactaaacacacctataaacatatactcaaaattccaaattttacagactagtaatttcagatttcttaaactaggattttcttctttctagttttagtcaacacgtctacattcttcatagcccttgcttttccatgattttactaatttattttaagcctttctattgttatattaagtagcctcctttgacaacctacacttttatcattagtgttctagttccaaggttaaagaagaatgcattacatagattggacaagtgaagacattagtatgggattgtcataaaggatttatcagcatttgaagctcctgacaagcttttttttttttaatttagaagaatgccattccagccatttaaataaaatctccaggagaagactattcaggttagaccaatatcaagtcgaaaagacttgacctattaaaattattccagtttgagttttaggtgggtggggcatcttttattacaaaacaaccaaatgagtttttaaaaagatttttctttttcttttttctatttttttttttgagacaagagtctctctcgctctgtcgcccaggctggactgcagtggcgccatcttggctcactgcaagctccacctcccgggttcgcgccattctcttgcctcagcctccccagtagctggtaccacaggcgcctgccaccgcgcctggctaattttttgtatttttagtagagacggagtttcaccttgttagccaggatggtctccatctcctgacctcgtgatccacccgcctcggcctcccaaagtgctgggattacaggcgtgagccaccgcgcccggcccgcaaaaaaagatttttcttgacgagaacaaaccattccaccaagactttatccagcattgctttattacttcctagtcctggccttgagctaagactgtcaagaaaggtaggagatttcagtttgttttttagcctttgatttaaaaaatcacgcatagtatttgctgcaggcagaataacacttgcagaagagacagcaggggaagggactgggattcttcaaggggcagcttgactgtctgtccactactgttggtttggtgctcaggcttcagaattttcttattgcaaattattacttagacagtttcaaactttcccttcctccttgttttctttttgttagaagtctctctttattttttcaaacatgcagtcagactgaggttttcaggctgagaacttgtgcaaatgtatgaactcagacattgaagtgtacttagcgaagttttaagagttaaatcatagaatgcagctttcatgttttcttactggatttcctctgctatcagcatcagttcagaccacattatgaatccagttgagaaaaactgcactttcttcccaagggcacatgttagaggagtaaatgatggtacttaagaacacatatttagaatgcacatttttaagttttatggaataagaattctagttgtgttttctgtgaaggtgactttttaacaggttttttttttttttccccctaagaatgagtcattttctcacatttttcttcattatagggattttttatttgggtaccatttaccgtttattttctttaaaggccaaagaagctcacagtgatgagcttttgctattgttactgtataaacacatttgcttcatttccaggtacagcgttcatgtaaaatgaaactaccttataaatgcacttgagaaagaatgcaacagtgtctattgttcaggatgcttgtaatgttccttttcttttttacatatgctttccggatgagtcactttaatggtatgccgttccgctgatagtaattcttcaactaaatatattcagttaaggaaaattacagggtacttatataatcatgtttgggcctattcacatatagacttgcaagagtaaattcttacttggtctttcttagagcaaagatgtaagaagtgctccgttaatttgtcaatggttacaatgaatagaaacatttaattcagaaaaaaatccacaaattcctggaaatgcttttatatttacatagaattacacattcttaatatggtctagacagtgtcactggaatactgtgattttttttcttgcatgcatatctgttctcttatatactgtgtaattgaagagtccttccgttcaaactcttgcttaaaatatgtatcttatactttaccttaggattatgtattagagaaagtctgtcatttaaaatgttttgaatgaggatcaggccactatcatatatttgcttgaagccagggaaaaagtatatgtatatttttcaactgaagcaagtagataaataagatatgtgaggaaagtttctcctacatataactcaagagagtacactaagcttaaaaggttatttatggagtacaaggaagaaagctataataaagaacccgatagctataatttaattttttagtgttataattcagattcagtaattcagtagcagatttaaaaaatgaaatgagagaaaaaaaattaaagtgctaccagactgactaatcagtcattgaaaatgcctgtagtgggaatttactcagatagaaaatgtttgcactgtcattaaagaccccctagtttatattagtgaactaatataatgacaggcacaaaaatataccctgaggctgaggctgtgcaaaggcaagcatttctaacccactctggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaggtaaacacatattaattcttttctaatactttttttttgtctgttaccttttagacaagtctagaaagccaaagtgatgaacttttaaatgccaaggaaatacagactattgcatgggttttaatttccagaaatattatttaaatttggaacttgctaataagtctgataaattggctgttagttagtgtaattgtcactagttcccaaacctaaaattccatgtaccctgtaaaatctaaacacagaaaacacaatctaaatttagttctctttattaaaaaaagaccagctgggcgctgtggctcgcgcctgtaatcccagcactttgggaggccgaggagggtggatcacgaggtcaggagatcgagaccatcctggctaacacagtgaaaccccgtctctactaaaaatacaaaaagttagccgggcgtggtggcgggcgcctgtagtcccagctactcaggaggctgaggcaggagaatggcgtgaacctgggaagcagagcttgtagtgagccgagattgtaccactgcattccagcctgggcaacagagcaagactgcatctcaaaaaaaaaaaaaaagaccaatattacgttaaattaggccatagtagggatagcaggttggaaatgtctgcatttttttcccgtagattacatctaaatagttgtttaattcgtggtagcatgtatacagtgggaatgtgtatgttggaaggtagggtgtaggaaagaggatagtgaaatataaaatgaatatttatgtactaggtataataataagtactttatcaaatcatttaacctaaatgactaccctttaaggaagatattatcatcatcattttgcaaatcaggaaatgaaggcctagagaagctaagtcattggcttaagataacctaactagtaatatgtatggctgagattagaacctaggtctgtctgattcctaaaaccattcctaccccatccaattctgccacagcagcatatataagtaacatgaccttgtgccaatgaatgataaagagtacaggttttatttcatgatgctggccttccaggctccagaaatactgctttacatttacaatttcctgagatgacatcacttatacccctccttaagagtagtgcataccttatagaatttttgtattagataagttaatacataaaactacttagaataatgtctagcacatagtaagtactcagtaaatgttggttattacttaagaacttaagtaatgactaattctttttttttttttcccgagacggagtctcgctctgtcgccatgctggagtgcagtggtgcgatcttagctcactgccacctccgcctcttgggttcaagcaattctcctgcctcagcctcccgagtagctgggactacaggtgcctgccaccgcgccctgctaatttttttgtatttttagtagagatggggtttcaccatgttggccaggatggtctcgatctcctgacctcgtgatccgaccgcctcagcctcccaaagtgctgggattacaggcatgagccaccacgcctggccagtaatggctaattcttacaccacagaaggactagttgaaggaactgggtatgtataggctgggtagattaagaagattcaactgatacatttcttgtaaaataggtagtagacttgatcagtgctactatgaggcaaaattaggagtaatagataagagtttaagtaggctgatttttttttttttttttttttttgagacggagtctcactcttttgccaggctagagtgcagtggcgcgatctaggctcactgcaacctttgcctcccggattccagcgattctcctgcctcagcctcctgagtagctgggattacaggcgcccaccaccacgcctggctaatttttgtatttttagtagagacggggtttcaccaagttggccaggatggtctcgatctcttgaccttgtgatccgcccgcctcggcctcccaaagtgctgagataacaggcgtgagccgccacacctggctaagtaggctgatttttcttatgagtaaataaaaaaattctagtgatatcaactgtcaacaattgaataaggcacttaggatgtagggagtactctgttttagatctaatatatgcaacaccccagatttactgggcactcctttgccatctcccacctccaaacccaggctactcatttcccagccatagtgggaagttaacattgctagaaacaatttcaccaatgaaggaacaggagatgctaaggagtaagcaggtaaatgaattgctcattgtctcctctaagcagctcttttttttttttcttgagacagagtttcactctgtcgcccaggctggagtgcagtggcacgatctcggctcactgcaacctctgtctcccaagttcaagtgattttcctgtctcagtctcccgagtatctgggattacaggcgggcaccaccatgcccagctaatttttttgtatttttagtggagacggggtttcaccatgttggccatgctggtctcaaactcctgacctcaaacgatccacccgcctcagcctcccaaagtgctgggattacaggcatgagccatggcacctggcctctaacctacttttctaagttacatttgttttatctggagaccaggactgactagataatttttgggtccgggtgcagaatgaaatgtggcaccccactgcaaatttttattttattttatttatttatttatttttttgaggtggagtcttgttctgttgcccaggctggagtgcagtggtgggatctcagctcactacaagctccgcctcccaggttcatgccattctcctgcctcagcctcccgagtagctgggactacaggcgcccgcccccacgcctggctaattttttgtatttttagtagagatggggtttcactgtgttagccaggatggtctcgatctcctgacctcgtgatctgcccacctcagcctcccaaagtgctgggattacaggcttgagccaccgcacctggccaaaaagttattaagaatttcaaaatgacaacaaagtattaaacaaaatgcagggccctttgcagcatgggatcttgtacaactgcacaggttgcatatccatgaagtcagccctgacggagacaacctgagacactaaacaaccagcatttttttttttttttttgtaaagctatgacaagttctggaacttaccctcttgtatttgctgtctttccctcatgcctgcttctctgggattatatcccgctcaccccaacaaggccttaagaagtaagctctaacttaggctatgttttgcagggactcagactgtgatactctgtaacctgagtttttcaaatttaagaggctggtccaaatctcctttaatgtcacttttacctcaaaggtaacataattcccccatgcaaagataaacactttacataatggcattgtttaatgcagccataaatttctgtataagctagaattctcagattattacatctccaatattttattctcttttgttcaggcataatataaataatccattagaggggaagaatggaggagcctaagaaagaaaggtgccctttacttttttttactttatccgctttcctcacattcccatttgtctaagcatctcccgaaccacgtctatatattgttaggcagatttcaagtccctgctctctttctctacttatataataattggtatggtaacttcaaatcattatgattatatctaacctctccctgtactttcagttgtggaagtagacataaatttaaatgtgaaccaaaacttcttgaaatgtacatattcatcaataaatatttattgagtgataaatactgagcacagtgataagtactgagggaaaagcaaaaaatcaaatatagatcttaccattaggcagcttggagttttataaaggaaactgttgtttatgtatatgagataaaagacaattattattcaaagcagaaggtgataggtcgaagatcacttaaacaaacaaaaagtacatatgaaatggtagagaatttggagtagagctctggagagatttatagaggactaaagattatacatgtgaaattcgggaggacagatgttcagaaaaatattgatttattcagaatgcaactttagagtaaaagtaatttccctgggttaaaaatattctcacttattacttgacatatgtagactgctgtgtgcatagcaatttgattaggctagttttgtattgaatgattggaagatgaagtcattatcatcatcatcccctttttactagtgccattactattgtgacctaaacctggccttttagcacattttatttattacagaaagttagggaggaaaaataacttttccttttccccattttaggttcattggccacggtctctataccaaaaggcagattagcaaaagaaaataatgcagatttatttaggttttacataacttgagaggggagcattcataaggaaatgaagatccaaagaaacagttaaacctgaggttttctatagtatgtttgatgaaaaatggagaggtgtggaaaaatatgatagggagaaggaaaagtatgtgctaagtataataaactgggagaaatttaacaagacctatttgttcagatttctatgtccctttattttcagagataaggatgttggtttcctcagggtgcatatagcaaagttagctctcaggccggacatggtggctcatgcctgtaatcccaacactttgggaggccgaggcgggtggatcacaaggtcaggagatcgagaccatcctgaccaacatggtgaaaccccgtctctactaaaaatataaaaattagctgggcgtggtggcacatgcctgtagtcccagctacttgggatgctgaggcaggagaatcacttgaaccagggaatcggaggttgcagtgagccgagatatcatgccactacactccagcctggcgacagagtgagactccgtctaaaaaaaaaaaaaagccacatgagtttttgtttgtttgtttgcttttgttttttgtttttttctttaagagaaaggatcaatctgtgttgccctgtctggagaagagtggcatgatcatgactcactgtggcctcgagctcccaggctcaagcgatcctcctaactcagcctcttgagtagctgggactaggcacataaccaccgcacccagcttgcttatttatttatttatttatttatttaaggcagggtctcactctgtcacctaggcaggaatacagtgatgccatcataactcattgcagcctcaactttctgtgctcaagcaatcctcccatctcattttcttttttttaaattttttgtagagacgaggtctagctatgttgcttaggctgctctcgaactcctgggcccacgtgatcctcctgcctcagcctcctaaagagctgggattacaggtgtgagccaccacacccagcagagcttatttttgtattttttgtagagatggggttttgccatattgtccaggctggccttgagctcctgagtccaagcaatccatccactttggcctccacaagtgctcggattacaggcatgagcccccatgtggggcctacatgagggtcttaagacctgtgcccaggaaagatcagatagtccttcctgcaggtgtcatttctaaaagttcttcagcttaaaatactcaatatgccaaggcaccatatttttgggtaatgtgccctgaacttcaccatgtccgtgtaacctaaataacataagtgactggtcaatgttttgtcttcacttttttttttttttttgagacggaatttcattcttgttgcccaggctagagtgcagtggcgggatcttggctcactgcaacctccacctcctgggtttgagtgattctcctgccttagcctcccgagtagctgggattacaggcacccaccaccaggcctggctaatttttgtattttttttttttttttggtagagacagggtttcaccatgttggccaggctggcctcaaactcataacctcaggtaatccgcccacctcagcctcccaaagtgctgggattacaggtgtgagccaccgcgctcggcctgtcttcactttttcaatcaaccaagtggggaaggagaaaccttttgaataattggaatacagcagagaaacctaagtgaaaaaattcaattttaaaatcagagagaattatttcttccatagcaaactcatcctttaaataaagcaagcaatgattggtgaaccattagcaaatttttggcaaaactttcttctgcaataaagaataatttccaagcttgtcagatctaaacaaatggaactaaattggacagagctatttaaactgacagattaatagaaaaaaaatagtctttagtgttagtgtttgatttttagtctcttgaacttccatgtatatttaaggtgatttctcctcattgagttataaagatgtgcccatcaacatgatgaatttgtatctgaacagtttggctgaaatttgccaaggggttgattttggcagtctcttaaatttttcattgtaatgctgatatgtctctgcataagactaactttgcttaaaaataagaaagaatcatagtatttttctatttgtgtttcatggtcctttaatgaaaataacagtatttcagaggcctggatttaaaaaccaatgtcacaggctgtccatcaaattataacacttacctcatctttgcaactagaatcttgccaaatgctgttgatattgatagaagtgttttcatacataattggcagttatgcagcaatagagtatctataaaatagttgaaagttaaaaaaaaattacctggtaaaaagaaggtctcctgacagatctgaaaaatgtgcatgtatttaggagcagtttgaatacaatacataaaattattagttgtcaatgagagcaaaaggaaggtgcagagaatgttaggggtaattacagcaactaatgatagtgtttgagggcaggctgaatctttgtgggtatgtacgttcatttgtgtttgctggggtttgctctaaattatctttctgtatcaacagttatttttcacatctctttgaaaaatactagagatgggaacttttaccatagatattggtttataaaaatcaggatattccaacaaaagaaaaatatttgatccttttacataatttaaccttaaatcatttatagagctactaacgtgcattaataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaattacttaagaatggcaatttagatttatgttaaaaaaaattttaactctcagtgttttggttcattaatgaatactgtgttttgtatggtactttagtgattctgagtaccttcatgaatacaaatattggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctatttctagcctgctggggccaatggctttagaaggaaactcatcacctctttcttcctttctctacccaaaataggttgcttgttctgactcagaaaaaattagatggtataggagagaaaaatcagtcgttcttgacccattcgaaggttcatggctgacaccctataataccatattaacaagagcaaagcatacaaatttatttaatgtgagttttatgtgacacaggaaactccataaatgaagactcaaagaaacagggaaaaaccatgtattttatgggcagttgtgcagaagtatgactggtggataaaaggatatgatctaatggtaataagctgggggcaacccatgaaggctggttcagattattttctgtatctctgtatgacagtcttcccccaggtatggggaaaagacacctgtcatgtgaaggtctcttttttttttttttggagacggagcctcactctgtaacccaggttggagtgcagtggcgcgatcccggctcactgcaacctgggttcaaacgattatcctgcctccgcctcccgagtagctgggaatacaggcacacgccaccacgcccagctaattttgtatttttagtaaagaaggggtttcaccatgttagccaggctggtctcgaactcctgacctcaggtgaccagcccacctcagcctcccaaagtgctgggattacaggcacgagccacagcgcccggcctatgtgaaagtctttggtgaggaaggacagagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtgttctgaaccccaacactttacttttttaaaaaagtcaaagcatcatttttacttaccaatccttgcttcttctgtcagaaaagaaacccattcttaaaagaggacttcttagacttttaaatatgtgttgtggtccattcttaacatcttaaactatctaaaaaagcacatcaaccacgatgtcgaccttactgcttatatccagttgacaaattccttaccacatttacttgcagagattttgtcaatggcagggttttctgttgcccaaaatcagcttagctttttgattgactgctggttaaatcatttccccaaccggaggacagagagtgactgagcagcaggggcaccattaacacattgacaagaagagctgacagaatgttaatgacattaacaccctgtcaactaactatcaacacttgggatttcctcatagtatgagggaagtcatttgaagtggttacaaatcaagttactgagaaggcacattatcctttccagataattcaaaacagatttggggtcttcactgcactgccattatgttaattgtattccacctttatttattaagataataatttttaagtagatgaaaaaactcacagaaccaccagtgacattgatcacctttgagaacatgccagtaacaggtttcagggagatgataatccacactttgtaaagcaaatgtcatataaaattgacaaaatagaaatgaaagcaaaaacaaccctcaagagcaaagctgttgtgttttgttttgttttgtttttaatgaacatagtaattcaggtcattttctggtgcctaaagaaaaattgagaacttcagattaggctggaggggggaagttcatcacctctgactctctccttaccctcactgtctgctcctctcaaatgcagaaaattagaaagttcaatgcaaacatttatgagactgttcagggagaggagggtacaggatttaaaagggggcattgtcagtaatacagataatgcatacattgagaagcaaattgttttagaaaaccacaaggggggccgggtgcaatggctcacacttgtaatctcagcactttgggaggccaaggcaggtggatcacctgaggtcaggagttcaagaccagcctggccaacatggtaaaaccccgtctctactaaaaatacaaaattagccgggcatggtggcacaagcctataatcccagctactcaggaggctgaggcaggagaatcacttgaacctggcaggcggaggttgcaatgagcagagattgcatcattgcactccagcctgggcggcaaaaagagtaggactccgtaaaaaaaaataaaataaaataaaataaaaaaagaggaaaagagtgctttttaaaaaagtaagattcttagcattttttgaaatatactctcttgacaatggtactggtcaatggaatttttagtttaattgaatttaaatagaaagtattatcatttatgataataataaagtagtaggccgggcacagtggctcatgcctgtaattccagcactttgggaggccgaggcgggtggatgactaggtgaggagttcgagaccagcctggccaacatggcgagaccccgtctctactaaaactacaaaaaaaaattagccaggcatggtggtgcacgcctgtaatcccagctactcaggaggctgaggcagaagaatcgcttgaacccgggcagcagaggttgcagtgagccgagattgtgccactgcactccaacctgggcaacagagtgagactctgtctcaaaatgaataaataaataataataaaaaaaacagtaataatagtaataaactgttatgaaagaaaatcaaagccagaaagaagttaaagtggtaaaggccaattttattcagcaactattgcaataggagagagaccttactatacaacgaggctgcattctgatacaacaaaggcaagtggggatttatagccaagaagcagggtggaagtcaggcaatggaacattactagaaggagatatcaaagataaggggattccccctaaaccaacttgataggattcttgctgaaggcaggcaaggctaataagatatgaagagtggaggatgaggaatttgaccatatatgaagggtggaggatttttgctaaacagacccagtaggattcttgctaaaactggactgtcagggccaaggactgagcctaagaatgaggcctagtcaaaaagaggactcaaggctgggcgcggtggctcacgcctgtaatcccagcactttgggaggccaaggtgggtagatcacctgaggtcagaagttcgagaccagcctagccaacatgttgaaaccccatctctactaaaaatacgaaaattagctgggtgtgatggcaggcgcctgtaatcccagctacttgagaggctgaactaggagaatcacatgaacccaggaggcgaaggttgcagtgagctgagatcacaccattgcactccagcctgggcaacaagagcaaaactctgtctcaaaaaaaaaaaaaaaaaaaaaaggactcagaggaacctgactaaaatttggttcaagagagagtctttgtcactgtttagttaatgtcatatgccagccattatgctaggaatatctatatctatatatctgtctatatattttcctaagtgaccgccaaagcaatactatgaagtaggtactattactaactttattttattttatttattttattttattttattttatttattttattttatttttgagacagagtctcgctctgttggccaggctggagtgcagtggtacagtcccgagttcaagccattctcctgcctcagctgcccaagtagctgggactacaggtgctggccaccacacctgactaatttttgtatttgtatttttagtagagacggggtttcaccatattggccaggctggtctcgaactcctgaccttgtgacccacccgcctcagcctcccaaagtgctgggattacaggcatgagccactgcacccagccttaactttattttaaatgtgataaaattgaggctatagaggttcaaccatgtacaggagatcacataggtaatatgtgtggttcatgagggtcagaattccaattttggtctttccgacattaaaccttgtgcttctaaccatggtattgtgctgcctccgaggttagacctgtttgaaaatctgagataagttctacatttgttccctgtgaaactgtttttttgcttccttttcaatctctctcaaatgggaaaaaaaatgttctttttgaaaggattgtaaactgatttaaaaattagctgctcacttataccatctcctccagaaagccttccctaatcatagcaatcaaaattaatttccctattccctgtatttttataacattttaatactttgattattgtacttgctggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatttggtaaaagttttcaattatgaaacacgtggtatcttaagcatacatagtttacaggtaataatagtgatgttagtataattcctcaagtaatatactctggtgcaaaatctcaatcatgtactgttttcataatgcagaaaaatatatcagtatgtttttgtataataaaagtgtgtttacttatttctagttaggatgtgtttgacatatagcttatgaaaagtatggcaagtaaacttggcttttcattcagtaatccctgctcttttcttctgtttttgtttgtttgtttgtttgtttgtttgagatggagattctttctgtcacccaggctggagtgcagtggcgccatctcggctcactgcaacctccgcctccaaggttcaagtgattcttctgcctcagcctcccgagtagctgggactacaggtgcataccaacatgcctggctaatttttgtatttttagtagagacggagtttcaccatattagccaggctggccttgaactcctgaccttttgatccgcctgcctcagcctcccaaagtgttgggattacaggtgtgagccaccacacccagcctttcttctggttttaaattgctttacaagatgaagactgaaaaaaaaaaaaaatacaagaaagtataggaaatcattgtttaataatcatgtaatcatgctgtcttttatgttgcaaatgtaagataggataataatgtagtacattgtctgaattaattaatgaagtgaggaatggaaaaaaatatatgacattactgaaaattatctaattgaattttaataataggattgtatgtatacctagtaagacatatatttatagaactataatcaatttgagaggatcatatctcagctacttatttaaggctaagggattcactaatggtaagaatggaaaaatcaatgaaaaatttaaaaaggccgtgtggacaagctttgcaaagatcatcagtgaggagaataggacctagtcacaaactgatgatgtctgaggagacaaagggcatgagtaactgagttgacaatggttctgagaggtaacggtaacaaaccctctttatcgtatcgaaagcaaatatctagtaagtggcttttcatatctgctaagacattatcaaatttgtgcacagcaactctgttcaattactgatctctagatgcctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaaaaaaaaaaaaaaaaaaaaaaggcctcttttttccaatttcattttatctaactttaaaaacatttttaagttctagctaactttgctttttgtatgtagaccagtaaagggcacatttttcaaaatgtagtgaatgcttgtagagtaagcaggatgctaacacctcattattcaaggaatatccagatgttcagtgttaaactttgattccttacttttttcactttggtaggaaagaggaagatggagcaatagagtttgaaaattcttgcatactttatgaatgatgacattctatatgctatgacacctataaaataaagattaagggggccaggtgcagtggctcatacctgtaatcccagcactttgggaggccaaggtgggtggatcacctgaggtcaggtgttcgagaccagcctggacaacatggtgaaaccccgtctctactaaaaatacaaaaattagccaggcgcgtggcacgcgcctgtagtcccagctactcgggaggctgaggcaggagaaccgcctgaacccaggaggtggaggttgcagtgagccgagatcatgccactgcactctagcctgggagacagagcgagactccgcctcaaaaaaaataataagagccagtcacggtggctcacgcctgtaatcccagcactttgggagactgaggcgggtggatcacggggtcaggagatctagaccatcctggctaacacagtgaaaccccgtctatactaaaaatacaaaaaaaattagccggtcgtggtggcgggcgcctgtagtcccagctactcgggaggctgaggcaggagaatggcgtgaacccgggaggcggagcttgctgtgagccgagatcacgccactgcactccagcctgggcgacagagcgagactccgtctcaaaaaaaaaaaaaaaaaaaaacaacaacaacaacaacagaaacaaaacaaaacaaagaaagaaatgatcttccttccactgctccaaacttctaagacaatgtatgtgaacgctcaacacagacagaaaacctctactgatatctgcctgaggcaggcaaatcacctgaggtcaggagttcgagaccagcctggtgaacatggtgaaaacccgtctctactaaaaatacaaaaattacccaggcatggtggcacgtgccaccatgagtagtcccatgagtagtcccagctatgagtagtcccaccatgagtagtcccttgagtagtctcatgagtagtcccagctactcaagaggctgaggcaggagaatcacttgaacccaggaggcggaggttgcagtgagccaagatcctgccactgcagtccagcctgtgtgacagcatgggactccgtctcaaaaaaaaagatcaaaaatgttctgagaaaacatcaagtagacctctttggctggaagtagtgagagctgttactaagaaagagggtaaaaatcaaattctaaataattaataatattggtctaaggagtttgaacagtatttggtgggttataaattgctgaaaggcaagaaactcttgttccgtcttctccctgcttccagccaccacatggtatttgcctgagagtgatacttgctacctgccaactactgatccaagtaagtactaaagtcagaattgtttccagtattagaaaggtatgtgtgtgcacccagactcatgtgtctgatggggcaaatggttatttctttgtcttcaataatgcatttaactgttctgtggttgaatttgtaatacagttataataacttgcatttatatagtgttttaaagcttgaaaagatcttttatcttctcatgtctaaccctaaatgttctgtagcaaaaattatcatattaagttttgttttgttttgtttgagacggagtctcactctgtcgtccaggctggagtgcagtggagtggtctcggctcactacaacctctgcctccttggttcaagcagttctccctgcctcagcctcccagatagctggattacaggcgcccgtcaccactccgagctaatttttgtatttttagtagagatgggctttcaccatgtaggccaggctggtctggaactcctgacttcaggtgatccacccgccttggcctcccaaaatgctgggattacaggcctgagccaccacacccagccacatattaagtcttgcacctacttgatgttgttgaggattcatccatttcacaaatatttattggttgattactcactgtgtgccaggcactgtgtcagatagttggaacacagtggtgaacaaaaaagatacaatgcttactgtcaaggagattttactttgctaaaagagatagacattcagcaactacataagcaactatggcaggtgataaggaagagatttataatgccatgccagtcaacaacctagttacaaggactgccctccagagagaataatacttgagctgagatctgaaagatgagtaagaattaattcagggaaaaggtgaagaggaatctttacctcagcctgtttatctacaggtgtttcaaatgtttgacagtttggtaccttggcgatgatttggttagtttcttgtttatggtcttactggatttacaatcctagtggagttttaaagttggagttagaaatctctcaaattgagccaaatcctgaggacattttatgtttaaaaaaccctcttaacttttctcccccaaaagttgcttttttactattggctagggattgagtatggatatttttgaaaagctatgtcagattccgtggaaaacctaaagctctgtgaaccttgtgggagctggaatttttcagctaagaggttcgaatagatttaggtatttatccaaaccgaacttttaaaccaccagagatttgcccattactagtttacatagagcttaactacagtggtttcctctttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctgtgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatattgctgtaaatgttgcttagctttgccatctgtcacatactctttttgcataatattttaatccattaaaatgtgtctttttcttttaaaaaacattagcttacttaggttacaatgaaaaccctttaagaaacagtcagtgaccactgacctttccatgtcttaagttactttgtaactgtttttgcctttgtgccccctcattaagatgaataatgacaatccttagaaacaggaaatgccaagctcccagttgcaatgctaacaagtaggaagtcccattaacttttcaacttctcagacaagaaataaatttggacatgagacattatttctgaaactacttgtcctcaggagcagtgattgaatgaactaaggacttgctttcactaagtggaatggaaaactcatgtcacagcatgtcagtttctgcttaatgaatgagatattccctggggaataaattaggcgcctcacgtacataactcttttagggtacccagacctcattgatttccttttgtagaatagtacccacgtgacttataagactcactgtacaactaaactgactgactttgaccctcatgaatagttttgtcacctgggagggtttggttagaaatggtctccaccccttaataagaaagtcagctctttgctccctgttggctcactgctctcaggccactaaatgaaaggcacttgggtgtcatttagagccatttaccaaatgaactatcttggcctgagaaagttaagcactgttgggcctggcaatttaccataatcaaagagctagagcagaaaatatgcaagatctgatttctggccaatttgtgtttttcccgtgttgctcttggcagatctctgttttgagtagcccactcttctacttctctccatgttattaatttgtaaagtgaaacaaattactgacccttgaattgtgctattacacatgcttgagtaattttatttcatttgcagagaatttcatttcatttatgtattatttatactctacctacttccgaaacaatgtgtactggcttattttaattgtaattcaaatcatctgagtatttttccaagtcctgtcctgaagaagacttgtgtcatcacacatcatttcacatttactgtgctatggtgatatattggttatgatgcaatttctctggccacctaaaaacgactgtattaacaaaacatcatgcctgcagtctaatgtaacttcttttgttgtggtgtggtctattgggaaagaacatgcaacttacagttatgtgcttagttctaccatttatgtgacctagggaaagtcatttgccacatcttgctcaagtttactcagttttaaatgtagttgttaatgcttactccccaaacctttcaaggttatggaaatcaatgcagtaaatactgcatataaaatgtctgtgaattcccatatttctccagttaacaccaggaagaataattgtcagctgaactgaaatgatcaagcagcgttcttgtattcaggcactgttcttttttttttcttttctttcttttttttttttttttttgagacagagtctcactctgttgtccaggctggagtgcagtggtgcaatctcggctcactgcaacctccgcctcccaggttccagcgattctcctgccccagcctcctgagtagctgggattacgggcactcaccaccacgcccggctaatttttgtatttttagtagagatggggtttcaccatgttggtcaagctggcctcgatctcctgaccttgtgatccacccgcatccgcctcccagagtgctgggattacaggcgtgagccaccgtgcccggcctcaggcactgttcagacaaatgagggatggagatgtgacaagagagagttcctattttgaggagccacagtgttgtggtgaaaaaggcccagcacacaaacaattataaaattcccaatgggataagtggcacaagtgaggtatgcaaaagtgtcatagctgacaggaagaggaagcaatgaactctggccaggaaaatgggaactaagtgaaaaattagggtaaaacaagataacgtgtgggaaattccttcagaaacactctgtggatactaagacacaatcttatcaatgtcatttatttaacaagcatttatgtattatttacaatttgccagacaatgttctaaatgtcttacaataggaaatcatttaatcctgttcattcaggtctgtttgctgcgaaaaggaattctagaagcactaaggaaatcctagatacagagattcctttgtcttctagtaaggaggaagcatactgggtcagttaacatccacatgtctgtgaggcaaatggttagaaaagtatataccaaaaataaatgaatgaatgaacaaactaaggaataaagacacaatgaaggagatactatttttattttttttttttttttttgagacagagtttcagtcttattgcccaggatgtagtgcaatggcactaccttgactcactgcaacctctgcctcccgagttcaagcgattctcctgcctcagcctcccgagtagctggaattacaggcatgtgccaccatgcctggctaattttgcgttttgttttgttttgttttttgaaatggagttcctctcttgttgcccaggctggagtgcagtggcgtgatctcggctcaccacaacctccgcttcccaggttcaagcaattctcctgcctcagcctcctgagtagctggcattataggcacccgccaccatgccccactaatttgtatttttaatagagacggggtttttccatgttggtcaggctggtcttgaactcccagtctcaggtgatctgcccgtctcggcctcccaaagtgctgagattacaggtgtgagccactgtgcctggcctaattttgcatttttagtagaaatagggtttctccatgttggtcaggctggtctcgaactcctgacctcaggtgatccgcccgcctcggcctcccaaagtgctgggattacaggcgtgagccaccatgctcggccttgaaggagatactattaacctcattttacatgataggaaaactgtggtacagagggactaagttgcccaaggtcacacagctactaagtggcagacctgagtttgaaccaaatgagtcaggctctagaggtggcagccttaacaaggatgctatactgcttctcccatcacccatcaacacagaagtggacatctttattgctggaatccagcactggaatcccttggtggtccttttgatctctgtttcagtacctatagaaacgacaaggacttaaccagctcttgaaacagctgactacatttttggacagttgtaattactagagagttctgaatttgagccaagatctacttttcctggaacttccacccattgatcctatgtctgctttctgacactacatagactaaaccttcttccacataactgtaaaagtattggaaaacatctcccatgcctcctgcttgaattccacattcccatgtaaaaagaaagtgacatttgagagcaattagatttcattattccattgagcatttatttatggggtgcctattgtgtgcaaattgttatacagtgtgctagcaatcgcagagaaaatgaatagcaccagattcgcatgtacaaagtatgtactctgcactaagctattccactgctacccaaaatgtgcaattatcatttaagatacaaactaatgaatagaattattgcctgcacttatttaaatcagggtttaaataagcagtgtcttgctgggtgcacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggccaggttggtctcgaactcctgacctcatgatccacccgcctcggcctcccaaagtgctgggattacaggtgtgagcccccacgcccagcctgttaaaaactttttgagtgcctatttgtgaacaagaaacctttctgctgtctcatctggcataaccttaacatcacgcatttatttgtgctacctaacataattagccatgatagaaaactttaatgtaaaagaaaagaaaagaaaactttaatgtagcatcaaatcttgaaaaatcattttaagattcagttgattattttattagccaggacctctgtgaaatgactctaggatgagaactaaaatataatggaatgggagaggttcattcattatgttagagatttggatagtgctaggcctttaattaattaacatttcattaataatctgtaaggagtaccagtaaacagcactttaattaagttcatgggtaatacattaataggtatagaaaataccaatgaagacaggaaaataattcaaatagaccagataatttataagatataggaaaataacaggaattccactggccgcatgcagttccctactcaagcaaataaaaggcagtattcactgcatacattggggtatagaaaataaacaagtacaataagtaaatatccttgttggctgagcgcagtggctcatgtgtgtaatcccagcactttgggaggccgaggcaggcagatcacctaaggttgggagttcgagaccagcctgaccaacatggagaaacccagtctgtactaaaaatacaaaattagctgggcatggtggcacatgtctgtaatcccagctactcgggaggctgaggaaggagaatcgctcaaacccgggaggtggaggttgtggtgagccaagatcgtgccattgcactccagcctgggcaacaagagcgaaactccatctcaaaaaataataataataaataataaataaatatccttgtcaacaatataatggctacaagaagcaaaaacttttgtttctggtggggcctctgaatatatttctacatatagaaatgtaagaatacaagaaatacatacaagaaatatgaataaatttttatatattttggctttatgcatcttagaaacaaaatgattgtatcatctgaatgacagggctagtaaagaacctacatttactgaatgcaaactactggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacacctcccagacggggtggcggccgggcagaggggctcctcacttcccagaaggggcggccgggcagaggtgccccccccacctcccagacggggcggctggccgggcaggggctgcccccccaacctccctcccgggaggggcggctggcccggcgggggctgtccccccgcccacctccctcctgggtggggcagctggccgggcgggggctgccccccccacctccctcctgggtggggcggctggccaggcgggggctgcccccccttcacctcccagacggggcggctgccgggcggagacgctcctcacttcccagatggggcggctgccgggcggaggggctcctcacttctcagacggggcggctgccgggcggaggggctcctcacttctcagacggggcggctgccgggcagaggggctcctcacttctcagacggggcggccgggcggaggggctcctcacctcccaaacggggttgcggccggacagaggcgctcctcacatcccagacggggcggcggggcagaggcactccccacatctcagacgatgggcggccgggcagagacgctcctcacttcctagacgggatggcggccgggaagaggcgctcctcacttcccagactgggcagccgggcagaggggctcctcacatctcagatgatgggcggccaggcagagacgctccttgcttcccagactgggtggcggccgggcagaggctgcaatctccgcactttgggaggccaaggcaggcggctgggaggtggaggttgtagctagccgagatcacgccactgcactcagcctgggcaacattgagcactgagtgaacgagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtataccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatacaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaattaatgccttcacaaagacaaatatcttgtttatggtgaggaagacttaaaagcaaatctggattttctgtttgactgaaagagtctagatacaggattttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaaggaaattgacagggctagtaattatataatttaaatgatgaactgtggggccatgctaaattgtgaaggaagggaggccaggaatcaactaatagatggcttaaatgaaaagatttctgcaggccggtcgcagtggctcacacctgtaatcctagcactttgggaggccaaggtgggtggatcacgaggtcaggagttcgagaacagcctggccaacatggtgaaccccatctctactaaaagtacaaaaattagctgggtgtggtggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgggttcctaacctttgaccaatgccactgcaaacactgtgcttaaggtgaggttgaagcagtaaaaacaacaatccaatttttttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggccgggctggtcacgcctgtaatcccaacacactgggaggccgaggcaggtgtatcacttgaggttgggagcttgagaccagcctggccaacgtggtgaaaccctgtctctactaaaatacaaaaaaagaaaaaaattagccaggagtggtggcaggtgcctgtaatcccagctactgtagaggctgagacaggagaattgcttgaacccttgaacccggcaggcagaggttgcagtgagccaagaccatgccactgactccagcctgggtaacagagccaggctctgtcaaaaaaaaaacaaaaaagctgggtgctgtggctcatgcctgtaatcccagccctttgggaggccgaggcgggcagatcacctgaggtcaggagtttgagaccagcctggccaacatggtgaaaccccgtctctactaaaaaatacaaaaaaattatccaggcatgttggcacgtgcccataatcccagctacttggtggctgaggcaggagaattgcttgaacctgggaggtagaggagacagaggttgtggtgagccgagatcgcaccactgcattccagcctgggcaacaagagcaaaaactctgtctcaaaaaaataaaaataaattttaaaaagctagtgtgtctatctccatattttttctgtgaattttaactattgtgatggtaatattagtgataggaccaggaatagcttctactaatacaacaagtaaacaaagtaaacacttttttttttttgagacagagtctcactctgttgccaggctggagtgcagtggcgcgttctgggctcactgcaacctccgcctcctggtttcaagcgattctcccacctcagcctcccaagtagctgagattacaggcacccgccacatctcccggctaatttttgtttttgtattttagtagagatggggtttcaccatgttggtcaggctggtctcgaacgcatgacctcaggtgattcccccacctcagcctcccaaagtgctggaattacaggcatgagccaccgggcccagcaagtaaacactttcatatacaatactgtcatttgatccttcaactatctggttgtcaggcaaggcatatgttattatccttagtttacagataaggaaacagttaagtcacttgccaaaaattacatgactagtgattgatgtatacaggatttgaatcagcccttctgacatttacactactgatatttctgctctattaatactgctagttttattagctacttatagaagcaattttttttttttttttttgagacagagtcttgctctgtcacccaggctggagtgcagtggatcctcctgcctcagcctcctgaataggtgggaccacaggtgcatgacaccacaccaggctaattttttaatctttatttttgtagaaacagggtcttgccatgttgcccaggctggtctagaactcctgggctcaagcagtcctcctgtgtcaccctcctaatatagaagcaatttttaaaacatccatttgtacagtatttagtagattttattaaattgtaactgaagttattgtctactgtgttttcaaagcctctcattacagagatccacatgatgaaatttgtactaccagaaagatctttatgtagaaagatgtctgttttcttttaatcagatgttaaaaattatgttacatgcatcactcttttagcctagctgccagagaacctatgtgccaatttaatacccaatttttttttttttttttgagacggagtctcactctgtcaccaggctggagtgcagtggggcgatcttggctcactgcaacctccgcctcctgggttcaagcgattcccctgcctcagcctcccgagtagctgggactacagggatgtgccaccatgcccggctaatttttaatatccaatttttaaaactagctcatacagctcctcaactcactcaagagcatgtctactattgttatcgttgataatgctattttcacattatatttaactttcttatattaaatgttataagttgcttcaaatatatttggaagcggtcaggatataaattcttaataaactaaataatagccatttggaaatttatgcaaaagaaaaaagcagtgtttaaatggctgagcaatagtataacagacttacccactcaagcttattaaagccagaattaactgacaagtcagataagcattccctaattaaatgaaagaggagaatgaataataacatgaaagtgaaaaaggatgtgtgagcctacaaaagacttaggccaacaaatctactcttagagattttctaatgtcactataaattctagtacctctgtgtcctactcaatatctctcgtgtttttatcgtcttccatgcttaggtcttgtttttattttaggcctgtctttgttgatatttctttcttttttttttttttttttttttttttgagacggagtctagctctgtcgccagtctggagtgcagtggcacaatatcttggctcactgcaacctccgcctcccaggttcaggccattctcctgcctcagcctcccgagtagctgggattacaggcatgcaccaccaggcccagctaatttttgtatttttagtggagacggggtttcaccatgttggccaggatggtctctgtctcctgacctcgtaatctgcccaccttggcctcccaaagtgttgggattacaggcgtgagccactgcccccggtctttgttgacatttctttattattattttgtgtatgtcatgactagggatttagatatttgaaggccttgtcttttataatagatataacaagtaaatttaggaactttatattttataaatagttgattatttttatagactcactatgtttagattgttttaggtgtttatttctttttgtaatttaagcacttagacttagttacactccagggaaaaacaacattcttttaatagtcttggtttcacattttcttgattctcttgtctatctttgtttgttcctaatttgtacataaatagtgattaaagttcagagtggctactgcaaaagataatgtttgaatttcaaaacttaccttatttcttttatgatattaatatgttcgaagtatcaagtaaaattttagcatttgagaccatgtggaatataagcttctatgtataggggagatcttataaaaacagcttgaaggaaggtgttcagcagaatttattggctggattgaatatctagtccaccattcacccctatatttgaatggattccttgccttcttatcctgggtaggttcgtagtttatcttgtcacatgccagccgttgttgtccaccctggacttcgcctcttaagtaatagacagcccctgactttcacccataaattatctgatggtgactggtttgcctccttggttttctttcactgcccagtgccagcctatctaagcaagatctctataaagataacatccttatttattaggactggaaagtaatttagaaacattccagttcgttggtcttaatttatggatgagaaaactgagacccagaaagaggaagtgacttacatctgtattgaataacattttgtaacatattggaatccaaacatgcagattatttctatagcactttgtctagtttttttaagaaattatatttctctttgagttattcaagttatatttgtgcatattagttacaggaggcagattagtctttcttactttatttcacacagatgattataggaatgtagagcatccacaagaaaaaaatcaatagcacttaatataacaatttagatatatcatactctattgaactttgaagctatttgttatacactatcatcatcatatttttttctcttaaacatatgtaggtcataaaattgaattgtaaaattgcgagtaatttttataatttagcaaatattcaactaatatttacggagttccaggtatgtgacattacatttgtgttttctttacgccatcactacttgatcttgcttttgtgtacgaaacacttcatctgcttttataattttcctctattttaccttctttcttcatttcccttggctgtcttcactagtcccaaaactttaatcaacgctttaacatgcaggactattagctttatgtctcccttttttgctcactctttgacacaccagccctaatcttctaaccattaactccatgtttctacctagatatagatccttaacccccgaactcagtatatttactaataaactcattcatcttcctctggaatctatttcttttaatgttaccatcactttccttagttatacaggtttatcactggtggttttcttgataccactctctcttgcctcccacatccattcaataattatcatttttaccatttgtttagcatttaccatgagcttttggaattcaaatattatcttttgcagtagccactttgaacttttgtcactattcacgtatgaattaggaacaaacaaaggtagacaagagaatcatgaaaatgtgaaaccaatactattaaaacaatgttgcttttccctggagtgtaattaagtctaagtgcttaaattacgacaatgaaataaacacctaaaacaatctaaacatagtgattctataaaaataatcaaatatgtgccaggcctttaacatttcatcctcagaactatcctatgagttaggagttactatggtctccattttacagttggatcaactgaggcacagagaaattagggaccttcctaaattcagaagactagtaaacagaagagttaagattcaaatctacacaatctgactctatagttaaggctcttaatcactgcattcagttgcttgctaaattaatacatgctgtattttcttcttttttttttttttgagatggagtttcacttttgtcgcctatgctggagtgcaatggcctaatctcagctcactgcaacctccgcctctcaggttcaagctattctcctgcctcagcctcctgagtagctgggattacaggcgtgcaccaccatgcccagctaatttttgtatttttagtagagacagggcttcaccacgttggccaggctggtctcgaactcctaacttcaggtcatctgcccacttcaacctcccagagtgctgggattacagggttgagccaccatacgcagccatattttcttcttttacaatgtatttgttcccatctagtcactttctattattaccttggcacaagctctcattacttcttgccagaactattgcagtagtagtctagccagttcccccgtctctacctccctccagtccatttcatatactttcctgagataaatctttcccaagcatggctaggtgtatttagctgtccttagcctagagaaaaatggagtggctccaaactaattaggcccttgaataatataggaattttccctactacccttcatttatcttgtgatctaagcaaacttaattacttcctgaaacaccattctctttatgtattaatttatctatgcctgaagttgtcagctttatgttcttatttatgtatattattttataattatccatattatacattatcctgtgtacatgtatctctgggacatatagctattgtatatgtgtattgcttgttttccctctgagatctttaaattctctcacatgtaagcatatgttgttgatgtattctgaaaatgttttttatgtgtcattggcgtgattgtgattttacaccataatttcccaatgtttatgtaaacattataggaactctgtatttgaatatgaaactctttatgccattagggcatttgccccatctataccttttctggttcctattttaaccagggacatgaatttgtagcctggccagctatagttataggtattggctacagaacttttttttttttttttttgagacggagttttgctcttgttgcccaggctggagtgcagtggcatgatcgcggctcaccgcaacctctgcctttcgggttcaagcgattctcctgcctcaggctcccaagtagctgggattacaggcatgcgccaccacgcccggctaattttgtatttttagtagagatagggtttctccatgttggtcaggctggtctcgaactcccgacctcaggtgatctgcccacctcagcctcccaaagtgctgggattacaggtgtgagccaccaggcctggcctttttttttttttttttttttttttttttttttttaaacaaaactaactggctcttacaagaatcagactcatgaccttggcctcattagcactatgagctaaccaagtctgacatatagaaattacacaagcgacaactcataagagaaaccagaactgtaagatggccttttggaaataattttcttaaagagcatatccaaatggagaccttcatttagcagcttataacaaattcttgatcgcagagttgcttcattttaagagtgaaaaacaatataacaatagcagtagaaattgaaagcagggaagttttcctgacatattgttttctttcttgtataatgtagatttatttagaacaggggctctaaccacctgtcagtaatatgtttctgtcaattttcctgtagatttttattcatggaaatagcactggtggcaaacatgagctagtgagtgaaagtatcctacacaattccccaaacgcctctgccagtttattttagtgttaatttttagtgcactttttttttttttttttttcagtgtggttggagcaaaacagagattaagagaaaattgctatggttctactggtttggataaatgggacaggtgccaacaattaccactggtgtgacttttccccccaatataagcattactattatgactattttgtttcctccttttacaaaatgccaggtggaatttatagagttcttattgtgaaaactaagacctattcctgattcttttctgaatttcatgactttgggaatatcctttagtttatatactacagttaccccctccataatatggggataccatggtgttaagattgatgtaagaattaatgtgtttaccagtcagtcttctagccaaacaaaaataagacacatttgcacagctttagttgtcagagaggtctggagcaattgttacatcctatatatacttctgcttgtgattttgagggcttagggtatgttgcttcaatcatatttataactaatgctgtatttttttactatttctgattgctaccttaactaaattaattttttcctcataccctgatactaggcatttggaatttagtaagtagctgaaatttgaataaatagcaaaaacggtataagtttttcaggttttttttttttttttttgagctggctagaacagacacatggattgaacatgatatctgacattgttgataatataatgagtaatatcaaggaacggtgaaggaagtgttgtagtttctaattttttcaatatggaagtgaatctactctatgataagtgcaacacagcttatctaatgctacttaaattgaaaaaaaaatgagagttccatgataagatttaaaaagtcatgtttgcaaaactcatttgaatagtcagaagtatagaaagtcgtcattaggcagctcttcatatatttgttactaaatcatctatgcagttacagattttatatatgtgtttttttcacatttaccattaagggactcttagtcctttttttttttttttttttattgaaacggagtctcactgtgttacccaggctggggtgtagtggcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattataaaaatagcgccaaatgtcagtctaaagcaaaatatttttgtatttcaataaaaaaatgaaaattatacattggatgaaatgtatatgactaaagtaaacaggcttttgaaatttaaatcaaggctctttcatagaatctgcataataaatgccatttatagttaatttattctatatgtcatatatttaaaatgcattcaaaatcaaatatcaagactaaattgtactccagttgaaaatccatgacaattttctctttgtctaaatcctagctgatatttgtttattgcacccctttcttttagaataatagaagcttgagaactatgcttggtaatataacaagaaagcatgattatagatataaatgatgtaacaagaattctattcccagttgtgcgttgtaagactgacaaacattggattaatgttgaataggtcatttgcaattctatgctgtttgtagagaaatcatattttgctattcttaggaacttacatatgagtttgttttggaggttttctgaaacatgaaagacataaaaaagacagacttttcctgtagcaattcatggaatacgttgtacattgttcttcctaaactacgtaactctctatgtgaataagacatcatatcctacaagccttacaaactttgactgtccctggacctcttgtgagaataaattaaagatgtcatgtctcatatattttgttatcagtgaggaaaaagaaataacattttctttttcatattttggtagagagtgcatatgattgatagtgaaatacatgcctatagtaactatttgtagttatatatagatggaacaattcagtgacgctttccaactttatcaggacctaagacttttacctttccaagtccaaagtgactaactgtaactctactagtaatttttttaaaaagcttatttaaaaaaaaaaaaaaaaacaagaagaatgtctccggccgggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcatggtggcgggcgcctgtagtcccagctacttgggaggctgaggcaggagaatggcgtgaacccgggaggcggaggttgctgtgagccgagatcacgccactgcactccagcctgggccacagagcaagactccgtcttaaaaaaaaaaaaaaaaaaaaaaaaaaaaaaaaaagaagaagaagaatgtctccatagttattcataacaattgtgaaaatttaagtaattggccgggcgcagtggctcacgcctgtaatcccagcactttgggaggccgaggtgggcggattacaaagtcaggagatcgacatcgcgccactgcactccagcgtaggccacagagcgagactccgtctcaaaaaaaaaaaaaaaaaaaaagaaaatttaagtaattggatgagttgttttcgtataaattggatgtatacgtttgatgtcctcattgtgttcagcaagctaagatgtatatgtacagttaaacatgagtcatgccctctatgatgagtttaaacatttaaaccaaatatttgttacatatgatacattaagtacaaatgttttttatctatggtaccttaatttatataacatatcttaggttataaactgtttgtttataacaacaaataaagcgaagtattcaaaatggcttgtagcaaggtgctgagacatgtgaaggagtgccagattgttcttgataatttacttcccacctctgactcacttttacatggtcagctttcagagaataagcacaaagatgttagcaaaattaagggcactttaaagtttttgttgagatgtttttaagtcttaaacaaaatttcaaatccagagatttgtgggaccaaaatgatgaattaaaagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaataagttagacacttattaaaccttttataaaagtattggatatggccgagcacagtggctcacgcctgtaatcccagcactttgggaggccgaggcgggcagatcacaaggtcaagagatcgagaacatcctggtcaacatggtgaaaccccatctctactaaaaatacaaaaattagctaggcatggtggtgcgtgcctgtagtcccagctattcaggaggttgaagcaggagaatcacttgaacccgggaggcagaggttgcagtgagctgagatcgcaccactgcactccagcctgacgatagagcaagactccatctcaaaaaaaaaaaaaaaaaaaaaagtattggacactcagccaggcatggtggctcacacctgtaatcccagcactttgggaggccgaggtgggcggatcacctgagggcaggagctcaagaccaacctggccaatatggtgaaaccctgtctctacttaaaaatacaaaaaattagccgggtgtggtggtgcatgcctgtaatcctagctacccaggaggctgaggcaggagaattgcttgaacttgggaggcagaggttgcagtgagatgagactgtgccattgcactccagcctgggcagcaagagcaaaactctatctccaaaaaataaaaattaaaaaataaaataaaataaaatagtattggacactcatcctctgaggaggcagtgtaactgggtgagaaaaaactctcttatatatcctttaggtacagctctgatttctgatgataagcttgctataaaacaatctattaaaaatgattctggctgggcatggtggctcatgtcccaaagtcatcccagcactttgggagactgaggcaggcagatcatctgaggtcaggagttcaagaccagcctggccaacatggtgaaacccgtctctaccaaaaatacaaaaattagccgggcgcggtgtcgtgcgcctatagtcacagctacttgggtggctgaggcatgagaatcgcttgaacccaggaggcggaggttgcagtgagccgagatcgcgccactgcactccagcctaggggatagagtgagactctgtctccaaaacaaaagatatctcctataccttgcataagcaaatgatgtgaggaaaacttgcttaattaagatcccaattttgttttggtgcttttgacactcttcatgcttgactaaactttttcattatggatttgcatttcttttactttttcttttcttttacttttcatttcttttacttatatgaataaaaggtctattcccttattggtttgaatttgggttacttggtgtctttggtcagtaaagagaaataatttgttttagcatccaatggattatggtctgcttcccaattgtttttgtttttcaattccatcctgatactggaacaacagatcatcttgtttttgctacaaacaggtgacacccaactatagtttgtgtatattgtaagacatacagagagtgttacaaattcccagtgttttcctctgtttcttagtcctgtactattcaggaattgtttcacacgagccttgataaactagctttctcaagaaagaaggttatgatatgttgttgttttgagatgttgaaattatgttaaattatgcataggaggtattatttatttattgagtttagtgctcccaaactgtattctacagaatattgttctacaggatgttacaataatgttaaaaaagggaaagaaaaagtatggaggtagtcaaggggatcatctgtggcaaataagttgtgaatgtgctgggttaaacaaagacaaacagatctattttctgcagaacttctcatgacttttaatatgctatttttattgtaaatctataaggggctatactataaaacatttctctaacttatttagccatggggtgtgtgtgtgtgtgtaatactttttaacatctcaagtatggcacacagtttgggaaaaggtggtctagctatttgttcttgtatgcaaaaggcatgggtaaaatggacacaggacaaaattgttaaaatgttgtttgtaacatgcctacagaccttgttggcaaagcttcctgattataggaaatccccattgaaatattcagggggagaaaaaaatcaaataggattattttttaaatgcattggctataacaccctgtatgttgaatgtgggaaatagactaattttagctaatatataaataaacagtatggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttggcaaaccagttgtaccctttgtctgaaacactcctgcacttcatctgaatggaaaccctttcatttctgttatgagattgaataaccaggtgattggaggaagactacagttaagtgtgatttatagacaatagattttgccagaggagattttgaagctatgtaaaaattctttttattttttcatgatatttactaaggttttatcgatttcagattcagtctcaatataaaatagtaataacattagtggtacaaatttcattagcacatacttagatgtaagaaatcataggctgggtgcggtggctcactcctataatcccagcactttgggaggttgaggcgggtggatcacctgaggtcaggggttcaagaccagcctgaccaacatggagaaaccccatctctactaaaaatacaaaattagccgggcgtggtggcgcatgcctgtaatctcagctactcgggaggctgaggcaggagaatcacttgaacctgggaggcagaggttgcagtgagacaagattgcgccattgcactccagcctgggcaacaagaacaagactctgtctcaaaaaaaaaaaaaaaaaagaaaaagaaaaagatatcattactatagattagattggcatgactcaaccttctttagaggttagttgtttctactgagtatgtttgccatttggagatctggcatttggggagtatttgtgcttcaggtggtttgaaaggcagatcttataagtttataacattgtcatctattttcaataggtttttgatattgaaaggaatcatttccaaacagtatcactactgtctaaacactgagtagttacacatacatattagcaatgactaaaaaaatactgtttgcagcaaggttggaaagaaatagaatgatctaggcataaaccacatatcttcctaattaaatgaaacagtatttcattgctgcttaacctactcttgtcttacagattgaccttgactcaattccaggtcagaagtcttcccacactgtgcttattaaggtctctggcatttgaaatggcagagctgctctaatcttcaaatcccatcgctttactttgcttgctatactcccttttccctcacttctgtacagcctacaagtcttatgtgttaaaaagcctctgctaaggccaggcgcggtggctcacgtctgtaatcccagcatttttaggaggctgaggctggcagatcacctgaggtcaggagttccagaccagcctgaccaacatggtgaaaccccatcttttttttttttttttttttttttgagacggagtctcgcactgtcgtccaggctggagtgcactggcatgatctcggctcactgcaagctcggcctcccgggttcacaccattctcctgcctcagcctcccaagtagctgtgactacaggcacctgccaccacgcccggcaaatttttttgtatttttagtagagacggggtttcaccatgttagccaggatggatgaaaccccatctttactaaaaattcaaaattagctgggcgtggtggtgcatgcctgtaaccccagctacttgggaggctgaggcaggagatggctcgaacctgggaggcagaggttgtagtgagctgagatcgtgccattgcactccagcctggggaacaagagtgaaactccgtctcaaaaaaacaaaacaaaacaaaaagcctctgctagcagatttttgatcaacattttcttttatcagtggcttgctcaattttatttatttattttttttttgagacggagtctcgctgtgtcatccaggctgaagtgcagtggcgtgatcttggcttactgcaacatctgcctcctgggttcaagcgactcctgcctcagcctcccgagtagctgggattacaggcatgaaccaccacacctggctattttttatatttttagtagagacggggtttcaccatactggccaggctggtctctcgaactcctggcctcaggtgatccgcccacctcagcctcccaaagtgctggaattacaggcatgagccaccgcgcccggccaattttacattttttatacccaattttcattgatgcattctcaagacttaaataataatgaagtgcctgcccatatgtaatatttcctgatactccatgggctttagcggtaaggtaactttgtcatataagaacctaaaataactgtagttacacttttaaaatagcttgttttgctagtgttgctatagaaaatgctttataaataacatttcaagaactgtgtttctctgaatctccttatcgttgccagaatgtttcccagtaacttatctgtatctacaaagaaagtgctatgtttagatactggtcagttctaagtcattttcattgatgacaacattaaatataagttatacaaaatagtagatattccaactaaaattttatctcttctttgtgaaggatctgtttcagtccttaagaaatagagtcatttgaatgggaaaacctagaaacagttttaaggcccagggtatggtgaagtcaccaacctgtttcttctctgccagttctaatcttgacataacaagaaagttactggacaatcaatcatgacctttaggggtgtgggggaaggaaaagaaaagacaagtttaggcagctcctctatttctaaagaatgtcatagagaaatttaaagaaatccttgctatactttacctggccccctcctggattaactcatgaggcaaatgagatttcctcactctgaatttgcaaagcgacaaaatttccaccaaagaatcagcatgaatgggatttgaagaatggaataaaaagtgaattaaattactgatcaccctaattttcaatactcattcattcattcagcaaaaatttattaagtgcctcctaatctgctagatagtgttgtaggttctggaaataccatagtacacagataaacatttctgccttcctggagcttatgtaatagtaaggaaaaacagatgaaataaagacattgcaaagtatgttcaaaggcgataaatgccatagggtataaaagtgaagagggagtttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagagtcgtagaagataaggtaagaaaaattgtgaggggtggagggagttgtacacccaaatgatatagaaacttatggatctgccgggtgtggtggggtggctcgcgactgtaatctcagcgctttgggacgctgatgcgggcagatcacttgaggtcaggagtttgagaccagcctggccaacatggtgaaaccccatctctaccaaaaaatataaaaattagccgggcatggtggcaggcgcctgtaatcgcgctacttgggaggctggggcaagagaattgcttgaacctgggaggcggaggttgcagtgagccgagattgcgccattgcactccagcctgggcgacagagcgagactccatctcaaaaaataaaaaaaagaaaaaattagaaaaagaaacttgtgggtcataataaggacctgagctattatttaaagatgagaagccattgaaaggttttgagtggaggagagacatgcactcagttaggtacaaacagaatcaccctgaataatgtgttaagaacagactgataagcaaggcagatgggaagcagggagacccataggaagtaattgcaataatctaggagactattgcagtaatctaggctagtattagtagaggtgatgaaaagtagccgaatacctagatatgatgtaaatgcccagtgggttcaccttgccagctacctagacagagctgatttatcaagataggacagttgcaataaagaaagagtaattcactcagagccagctgtgcagtacaccagagttttattactcaaatcagtctccctgagcattcggggatcagagtttttaaggacaacttggtggggggaagcctgtgagccgggagtgctgattggttaggtcagagatgaaatcatagggagtcaaagctgtcttcttgtgctgagttagttcctgggtgcggggacacaagatcagatgagccagtttatctatcagggtgatgccagctgatccatcaagtgcagggtctgcacaatttctcaagcactgatcttaggagcagtttagggagtttcagaatcttgtagcctccagctgcatgactcctaaaccataatccctggctaatttgttagtcctacaaaggcagtctagtctccaggaaagaagggaatttgccttgggaaatgccgttatcatcttttttttttgggtgggggaggacagagtctcgcctgtggcctaggctggagtgcagtggaacaatctcggctcactgcaagctctgtctcctgggttcataccattctcctgcctcagcctccccagtagctgggactacaggcgcccgccaccaagcccggctagttttttgtgttttttagtagaggcggggtttcaccatgttagccaggatggtctcgatctcctaacctcatgatccgcccacctcagcctcccaaggtgctgggattacaggcgtgagccaccatgccggcctatcatctttgttttaaactataaactaagttcctcctaaagttagttcagcctacgcccaggaatgaacaaggacagcttggaggttaaaagcaagatgaagttggttaggtcagatgtctttcactgtctcagttacaattttgcaatgctagtttcaatgtcagtttgtaccatatgaaattgccaatatttgatcacttttgatcaatagaatcctttttttttttttttttttttttttttgagatggagctctgttgctcaggctggagtgcagtgtcatgttctcagctcattgcaacctcctcctccccagttcaagagattctcctgcctcagcctcccgagtagctgggattacaggtgcctgccaccacgcccggctaatttttatatttttagtagagacggggttttgccatgctggccaggctggtcttgaactcctgatctcaggtgatctgccgcctcagccctccaaagtgctgggattacgggcatcggccagtgcacccggcaagaatccataatttctagtggttctttctaactttttgaaagtagaatggatagaagtttactaaaattatacactagatgtgtgggatatgagaggagtgaaggaaaattcccaaggcttttgagctaagcacatggtaagaatagagttgtcattaactgagacaatggagagcccatggctattaattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgataatgtactttcaatagaggtcacagtatttgtctagaatgagttaaagataagagtctatacctttgctgtgactttatctttttgcctgactagtgtctctttgatatatatctttctatactgtaggggctgatttcttctgcgtttgaatttatgaggcaaatagaattggactgaaaaggtgttagagaatttagagaaatacttaaatgaatcactcagtttgtttaaatttagaaacaataaaagctgtttgttcaggctactattttcaagataccatgttgtgtatgagcataaatagtgccccaggttgctggaaggcaggcttggttttgtttttgagaaatgttttagttgaacaatttttaaaagaagaattgatccacatgtttaacatttcactcccccagaccagcctgggcaacatggtaaaacaggaaaggaagatgagaaataatattctcctattattatggaaacatacctttaatatatggccattgactgaatgcttagttttacttatcattctccttttttgttagactcttagccttcttctccctgcccttaaagaccctataagagagaaaaacaggtatacaagtcagttgccatggtgcacaactgtagtttcagctattcaggaagctgaggcatgatgattgcttgagaccaggagatctgggctgcagtaacgatcatggtgcctgtaagtagccactgcaccctagccttggcaagtgagaccctggctcttgaaacaacaaaacaaaacaagtacacaaataaagcaagtaatataaggcatgatatggcgtaacagagatgcttttgtgttttaagcatttttactggagattaatgagtggatgtgaattttaaggtgtgctccaaggtacccaaggggtttccatcaagatgcatcagaggttgctgatgggattggaaacttatcccctttacccccactcctctacacacatgctcacacagagcagctccacttttatctgttttataaattgggtttttgtgtagcactgtgaaaagaaagtgttctttttgtttgtttgttttgggttgggatgggtttgaaagtgttcttttaaccattttttttttttttaaaccacagctgtaatagaaagaacacgagctttggagtaagaaacatctgagttgaaattttagttttgctcttagatgatgcttacctcatccatcaccataagctcttccttgtttctcaattttgatcttcattttgagtatcaaatgagagatgtgtagagtgcctattgcattgactgatcaaggattcctgttagattggaaaactgtgagttctattaaactattttttatatcatagatattattttaaaaccttgagaaaagcaggttcacatatttattaagccgatgattacattttttaacttagcccaagtttctttatgtaatttggcctaaatatatctgagatcctttaagccatctatcgatatttgtacttgatcatcgcatcatagtgatctcacgatgttgagatgttcaactcctgagcccttggggtagccagtgccctctagcgggttggtttgccttagcaaccttgagcagccttgtccgtttaccctagtgtgccatgtaaataatatcatttcctaaatatgccgtgaagacattgatttaaagaagcatagatgatccttcctgttctgtttttctcctcctctgttctttctcttctcactttcttgtcttcaaatcccctggtttaaggccaaagaaatcagtagactagccgagcgcagtggctcaggcctgtaatcccaacactttgggaggccgaggcaggcggatcacgaggtcaggagtccgagactagcctgaccaatatggtgaaaccccgtctctactaaaaatacaaaaaaaaaaaaaaaaaaaaactagccgggcctggtggcgcgcaccagtagtcccagctactcgggaggctgaggcagtagaattgcttgaacccaggaggcagaggttgcagtgagccgagattgtgccactgcactccatcccgggccatagagggagactccgtctcaagaaaaaagaaatcagtagactagagggtaggcagcataagcaatttgatgatgggagacagtccatttctttttcctgtacctcaagccctatttagatagactttatttacatattaaggaaaaaaaacatgttttgacaagttgactagtttcctcctgggtttccattttccttgagcaaaatctgcaacagtctcatgtagatggggtaaatgggtttatgtgtgggggtccatgccacatgaagaagttagatgtgcactagcttccataataggaacagcaagaattgaaacagaaaggaaatagaaaccagtgcagggtgtctaggcaagatgagaaagcaaattgcttggaatatgaattgcatgatgactattgtaatgcttctattattttctgaaaagtaagaatgtctttatgttgagcttgaaccagaaggattactgagtccattctgtgttcaatctgtaaagaaataaactaaaacaggtgaacattgaaaatgttacaatgtcataatttgttttttttagcccaatcaccacttttctgattgcaaagtaagtccttcagtcaaatccattgtttgtctgtggttcttatgattaacttccttaaactcaaataacgtttgaaactcaacattttaaggatgtttttaaataagcattattctaacggtgcaaggacattttttaatgccttgccttctcttgcctaggaaatagaaggcagaattaagacttgaaacatcattttcctttcttttaagtgatgattcagtattttagttgattgtaaacagacattcctcttttgcttatgattacctgatgataattcaagttaaatcattgagataataaatctcatacattgatttgatgagagaaatcagtgttaacgccaaaccatgttgaaattggtcttagagatataagccattttgcaggagtgtgtttttgactaatcatgccagagagaaattaatcgaattgtggaatattacactttgcattcatgaaagaatgtgataatgccactactcttcaaatgcatgaatgtgactgaagggaacagtaattatctgcattcctttctactttaggagccagtgtatcctgaccttgtccgtgattgtaatcaccgtaacttgattagagattttttaaattatttttcaattgacacattttaatttatttatggggtacaatctgatgttttgatacatagctatattatgatacaaccagtttagctagtgtatccatcacctgtgcatttatcatttctttgcagtgagaaattatataagatacaatattttactgttaaacatagttaccctactgtgcaatagaacaccaaaatttattcttactatctaattgtaactttgtacctattgaccagcctctctccatccttcccttcctcttcccctctccagtctcaaccactggtctatccttttttgtttgtttgttttttgagatggagtcttgctctgtcgcacaggctagagtgcaatggcgccatctcggctcactgcaacttccgcctcccaggttcaagcgattctcctgcctcagcctcccgagtagctgggattacaggcacctgccaccacacccggctaatttttgtatttttagtagagacggagtttcactatcttggccaggctggtctccaactcctgacctcgtgatccaccagcctcggcctctcaaagtgctgggattacaagcgtgagccacaacgccctgccgcccactggtctattcttgattacagttttctttttttttctttactttttttttttttttttttttttttttgagatggagtttctctcttgttgcccaggctggagtgcaatggcataatctcggctcactgcaatctctgcctcccgggttcaagctattctcagcctcctgagtagctgggattacaggcacccgccaccatgcctgactatttttgtatttttagtacagacaaagtttcaccatgttggccaggttggtctcgaacccctgacctcaagtgatccacccgccttagcctcccaaagtggtgagattacaggcatgagccaccacgcccggccgattacagttttcaagatgtcatgtcatccttgctgttctaaacatcacccaaaattggagaaagaatagtggtaaaacagtagcgacattaaacttaggtaaagcttctcagtgatattattaatagaatcagaaataaatgacgttttcttataaggattcaaacacagaaaatcttcaagaaataccagtagctgtattttttttcccttctgagccaaaggttagattgggaggactgtattttgatagactccttacgacattttaaaataaattcttcagatctagaaagttgactctgaatattttccattcataattttgagaattttctaaaattgatgagcaaacagttatgcagtaagaaaaagattgtatagaaattgataatttgttctctttccatttatcgctgatgctccctttctcacttctacaaataaaaagtttcaaatctttgttctttgtctcttccatggcaatatagaagttataaggtaataaatcaaatttggaaaaagatcttttttcctactctaattgtagggctttaactcttatagagaatcagaacgttaaagtacttctcatataaaattcccctttttttttttttttgagacggagtctcgctctttggcccaggccagactgcagtggcgctatctcggctcactgcaagctccgcctcccgggttcatgccattctcccctcagcctcccaagtagctgggactacaggcgcccaccactgcacccggctaattttttgtatttttagtaaagacggagtttcaccgtgttagctaggatggtctcaatctcctgacctcgtgatctgcccgcctcagcctcccaaagtgctgggataacaggcgtgagccaccacgcccggccaaaattcccataatattatttcaaaatagaattagtgcctagtataacacctagtactgagtaggcactcagtcagtatctgtgtaggaaggaatagatgggacatgataaatataattgataataaatattggccggttgcagtggctcatgcctgcaatcccagcactttgggaggccgaggcaggtggatcccctgaggtcaggggtttgagaccagcttggccaacatggtgaaaccccatctctactaaaagtacaaaaaatagccgggtgtggtggtgtgtgcctgtaatcacagttacttgggagactgaggcaggagaattgcatgaacctgggaggcggaggttccagcgagccaagattgcgccattgcactccagcctgggtgacagagtgagactctgtctcaaaaaaaaaatatatatatatataattgataataaaaattgataatattaaataataataatattaaatatactcttgaaagactatgtttttctgctgctagacatactactttgtaaccaaaaaagcatacttatttgtttttgtgaaacattcacaacataaatggttaaacagcataaaggaccgtatgtttgagtgttacctctaaattaactaactgtaggcactgaaggatttccatgaacacaggacttttagtactaaaactagggggtctatcccaggcaaactagaacaaactgatcacccttaaaattatctctcaatttggccaggcgcggtagctcttggctgtaatcccagcactctgggaagccgaggcgggcggatcacctgaggtcaggaggtcgagaccagactggccaattgtggtgaaaccctgtctatactaaaaatacaaaaattacccacacgtggtggcgggcgcctgcagtcccggctgctcaggaggctgaggcagtagaattgcttgaacccaggagactgaggttgcagtgagccaggatggtgccactgcactccagcctgagtaacagagcgagactccgtctcaaaaaaaaaaaaaaaaaaaaaaaatctctcaagttgaggctgccttgaatgtaggttaagctttctggataacttcttacattaaaatttttggataatttacattacaaactgagtcaaatgaaagatcttttattttacttgaaatatataacatattcagcatagaaggagtaaaaagaaaagtataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaatgaatttacatgtcattgcattcagatttacatatatacatatgcatgtacgttcacatacattcacatatgtatgtgtttttgttgttgtgttgttatttttttttttttttttttttttgagatggaatctcgctctgtcccccaggctggagtgcagtggtgcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtctgggagtctatctgaatctactgattttgattagtttttaaagaatgaaaaaacaaacaaaaaaaaaccctttcacatgaaacctaccactcaaaatttaagttggattagagatagtgctttgagatttccttcctgactaaaaagtaggttgttgatagcaaaagatcttttgcaactctagtatttgctgtaaactatgatatattcctacaagtacaaatagaaatattttaacatttattcttaagtttatcccagttcttttttttttttttttttttgagagaagtctcactcttataccccaggtttgattgcaatggctcaatctcggctcacttcaacctccgcctcccaggttcaaatgattctcctgcctctgcctcccaaatagctgggattaagtcgcctgccaccacgcccggctaatttttgtatattttagtagagacggggtttccccatgttggccaggctggtctcgatctgctgacctcaggtgatccgcccacctcagcctcccaaagtgctgggattataggcatgagccaccgcacccagcccctgagcttactttttaagaactggcataggccgggcacagtagctgggattacaggcgtgagccactgtgcccgccctatgccagttcttaaaaagtaagcttggccgggcgcggtggctcacgcctgtaatcccagcactttgggaggccgaggcgggcggatcacgaggtcaggagatcgagaccatcctggcgaacacggtgaaaccctgtctctactaaaaatacaaaaaattagccgggcgtggtggcgggcgcctgtagtcccagctactctggaggctgaggcgggagaatggcgtgaacccgggaggcggagcttgcagtgagccgagatcgcaccattgcactccagcctgggtgacagagtgagactccgtctcaagaaaaaaaaaaaaaaaaaaaaagctcagggaccgggtgcggtggctcatgcctgtaatcccagcactttgggaggccgaggtgggcggatcacctgaggtcaggagttcgacaccagcctgaccaacacggagaaaccccatctctactaaaaatacaaaattagccaggagtggtggcgcatgcctgtaatcccagctactcaggaggctgaggcaggagaatctcttgaacccgggaggcagatgttgcagtgagccgagatcacgccattgcaccccagcctgggcaacaggagcgaaactctgtctcaaaaaaaaaaaaaaaaaaaaaataagtaagctcagaaaaagaggctctttataggctaaatcaaataacttgttgaacctaatttttaaatttggctcttatttgtgtactcagtatttagatctaatttgactctgataataaccaactttaagtgaagcagctaccctttggtgcctacagatgactctcctttcaataaaacatatttaaatagatgacagtgatattttctatgatattcccattcgagaagccccttgctgtggttctggcaaggcttccacagcaggtgatgtggggctcatgagaggagtgccttacttactcctatagaaagctataataaaaggagcaaataaatacctcttgtagctaagaatctgatgtaccacttaatattttcaggtggcaactgcactgtcatttcatataaaattcctttcattagctataaaaaacattgcctgcctgccagctgtttggaaagcatcgtaagatcaggaaaatgacaaaacagcccctcattcgcagtagatacaatgaactagtcaaatagtacatttttaaaatctatcttttgcaaaaagaatttttgcttttcatctcatgcgtttttgtttttaatgacggcatctcaatttttgttcttgtttttttctatctaagctaataaacagattgtgatagtctgtactcaaacacaaaggttcaagagatctggaagaacctgcatatagtagagtataaaaggcctgtgcaacttagactcaaatgtatcaatgcctacaggaaaacaccacaggtcagctctttgtatattctctagtcaggtaatgataacctaaactatctctatgagactgctgaaaagttatcgaagtaaattatttttcttgtcttttttttttgagatggagtctctcttgctctatcgcccaggctggagtgcagtggcatgatcttggctcactgcaacatccacctcctggttcaagcgattctcctgcctcagcctctcgagtagcttggcttacagacacctgccaccacacccagctaatttttgtatttttagtagagacggggttttgccatgttggccaggctggtctcaaactcctgacctcaggtgatccgcccacctcggcatcccaaagtgctgggattacaggcatgagccacctcacccggccaataaattatttttcttaaacatgtatcattcatcttagagtgtagaaacattgaccctggtgatgaccattgttatttgtgcacatggctgtggatgaagaggtaaatgaacagcctccattgtccactgcctgcgtgtggaggaggctctgtggttggccttatgtctgatgagtgcaatctgcatctgcaactctgcttcttatagccataatttgcctaatagtattgctcaaggagagaaaatacatatccatatcttcaggaatataggaccatctggtgagaattacttttaatggctacattgaatattagtagttgattgttaatacagagagtaggaaggacattataatgctcaatagttgtccagtctgggcagttactcagctgtcttagacaagaccaagttttgccttttttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactctgcatgattgattagtatccttttgctttgcaaatgtgcatatattaagttcagcattgcagtttgcaaagattcactcatggcctgccatggtaattgatgcacacctgtcctagggagcaatgtatgagtttttttgtgctttcacataagaagtctctggagtatttttaattggtcatctctagaagagggaaacaggagcagattaaaagtatacaggaaaaggaggttgttctacaagcagtttaaaaatctatttgaaaaagatccccaccacttataagctgaatagttataattaatttgtatccctgcattctaaaataagagtactcaacaggttttatttttatggacaagtatctgtgggcttaggaaatttctttctttcttgtcttttttttgaagatggagtctcactctgttgcccaggctggagtgcagtggcgccatctctgctcactgcaacctccgcctcctgggttcaagcaattctcctgcctcagcctccaaagtagctgggattacaggtgcctgccaccccgcccggctaatttttgtatttttagtagagacagggtttcaccatgttggccaggctggtctcaaactactgacctcaggcaatccgcctgcctcagcctcccaaagtgctaggattacaggcatgagctaccgcgcccggcctaggaaatttcattgttatttattgttgtttttgttttgtttttatttttgtttgagacagtctcgctctgtcgcccaggctggattgcagtggcacagtcttggctcattgcaacctccgcctccccagttcaaacaattctcatgcctcagcctcctgagtagctggaattacaggtgcctgccaccacacctggctactggctaatttttgtatttttagtagagacagggtttcgccatgttggccaggctgggctcgaactcctgacctcaggtgatccacctgccttggcctcccaaagtgctgggagtacaggcgcaagccactgcacctggcctaatttttgtatttttagtagagacggggtttcaccatgttggccaggctggtctcaaactcctgacctcagatgatctgcccgtttctgcctcccaaagtgctaggattacaggcgtgagccaccacacccagcctgttatatgtttaaccctttttccaagttgacatttccctgatactttggctttttaaatagcatacccttccccacaattcatttaatgaatcccttcttaatttacttaaaaacaaagatgttcctccagaagcaaccagtttttttctgtattgtttagggattgtgttttctggttttgtaatagtatcagaacatataggtaaatattattttggagtctagtttaatcagatcactcttttgctatagaaatatgttactagcttcttaacggccaggcggagtgtctcatgcctgtaatcccagcactttgggaggctgaggcaggtggatcacttgaggtcaggagttcaagatcagcctggcaaacattgtgaaaccccatctctcctaaaaaatcaaaaattagccatgcatggtggcgcacgcctgtagtcccagctacttgggaggctgaggttggagaatcgcttgatcccgggaggcagaggttgcagtgagctgagattgcactactacactccagcctgatacagagtgagactctgtatcaaaaaacaaacaaacaaacaaacaaaaaacaactatgttattagctccttaaattataagtcatttcattgctttctctggacctagcatctatcattgctcttgtttacatctcagtaaacatctcagtttcaatctgatttagataaatgtgattttttaagctgaaattcctaaatcagtagtaagtgtgcaaatattttaaagattatttgccatatgttattttagatacttatccctatttttctgcttttaattagaaaaaataatttataaactggatgatgttaaaatatataaataatttattaatttcattcataaaatgagctctaatatatatacttcttatatttctagactaatatacagccacattcatcattttttcctagtacattagtatttttatctaaattaattttcacccgctaatgaatattaggaagcactatacatcattaaaagtatttattccaagatgatttccccaaatgtgttactatgtaaacatactctgtttacccctccctttccatcaaaaatagccttaaggcatcatgataaaaatgatactgtatttatggacaggataaatcaaacacagtgaagatgaaagaatcagattaggcattccatttgcttactcagtatggtttctcttatgcccaggtttccatctttacagaacttattgggcatgtttcacccacactgcaatgtaactgattttcttttctctgccatctgctgttcagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacactggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacacacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccacattttctttattccttgaaggacatgtagattctttcaacttcttggctcttgtgaataatgctgcattgaatataggagtgcaactatctcttcaagatcctgcctttttctttttttcagtccaagagctggctttgaataacacattgacattgaaatatatatggttcctaagatcatgtaattttttgagatgtcagagacacctagagacagcaaacacattaaagatagattcacagttctagtttatatccatgtcacaaactgaacactactgaagctattttgttattgtttgttttcctcaagcagaaaattttcacagggcacatttttgtctctaacaaaggaaagaaaagaaaagaaatgtgttctttggaagtaatgccactgtattcaaatagcttcttccacataaagctaaaaatgtctttcagagttaaataatgcagtttcatatttaagacatacattaaattgatactaggaaaaaaacacaaaatccaccagtgacccagtaaaattagtaaattcttaatgtatgtataagtatatacacatacatacctacacgtacacagaaatgcatatattttagggaaaccttaaaagagaaaaggagttgctgaacagcttaggaaatacagtacaaacaaaaagcagtattgtctgcaaaaaaatttttgttgcaaaagtaatattttccttgtggaaattctggtccagagttgggctattacctatattgaataaattcagggaaacattctgaaatgtttgactgctatgattgaagtattatattaaagtactttatatcgtgaaatgcacttgttttcaaccatgcaaacagttttattaagtaggaggatatcagggttaaggttaggtttacatgaccatatgagaaaatttatataaggtgatggcatgaatggattctgatcttcaaactagacaactagaagttggaattctaatgtcaggggtatcaaacagcccacatggaaaagaaatgagagtctttaataagcaattgggttagaaaatatatagtatttcaatgtcattattttatttcagagtaacatgtctgtcattgagatagtttactgtaggttaaattcagtatgaggttgccatgtacttgcaaggttcttaaccctgttttagagatcataagacataaaagtgtgcaaaatatattcattctagaatagggagtttcctacactaaacaaccagcttaaataatatattcaagtgttttcatgagaaaaaaatcaaaatactttttatcaagatgttagtgctttcattttacctgaatacttatagaatctagcattatacagctggaaggaaccttgcagaatttctactcaaattgctttattttgtatctgctgtgagggatgtaaattccacagatcatcttgtatatatataaaaagggctaaatctcttgcctcagttcatagatcttttgaatgcacagaattggctcttatctttattagtaaacttgatttggaagacatttccttttttgttgccacttctttacctcattggtgattttagttaagtaagcaaagataaacaagaagtggaaaagcagtatcagctgaattgaaaccactacttagattgaaaaagcatgattggacactatctataattcagtataattctcaaacctaaaatgggacatttgaaaataagtgtaggaaaaatacttataaaatgggaaaaatggaaataaaatgtccaaagaattcagaaaattatactaaagggtccaatcaaacccaaatatgtacatattcattccaaaacaacagacatatcagaagtacctggtaccataaaaattaaaatacacacacactcacaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatcctatatttggggggagtatatcaaggccaagcatattcggactaaaggaatgtccactgaaccaacaagaatgttaagggagccttgttaaagtactgtcctgatctcgatccgattggctaagaggaagtcttcctgtccttgctccttgtacttcttactgctttgtacttcttactgctgccatgcaacctgatctccattttatcaaggagcctatatacttcaactgcctattagatttcactatcccagtatttcacagataccacaaactcaatttgtctaaaactagtcattattctctgcccccaaaatagtgctcccttacttgtttctcaagttctgataaaacacaagctcacacaaaacatactaagagtcacccaggctgtaaaactcaaggggtattgtcaatattcccctctctctagccactaatatctagtcagtcaccatgttccatggattctacttccttcatattccttttttttttctttgagatggagtctcactctgtcgctcaggctggagtggagtggtgtgatctccactcactgtaacctccgcctcccaggttcaagcgattctcctgcctcagcctcctgagtagctgggattacaggcatgcaccaccatgcctgattaatttttgtagttttagtagagacggggtttcaccatgttggccgggctggtctcgaactcctgacctcaggtgatccgcccgcctcggcctcccaaagtgctgggattacatgcgtgagccaccgcccccgacccatatttcttatatctatcccctgctttccatttgcagtactgttctgttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggccgaggcgggcggatcacgaggtcaggagatcgagaccatcctggctaatccggtgaaacctcgtctctactaaaaatacaaaaaaattagccgagcgtggtggcgggcgcctgtagtcccagctactcgggaggctgaggcaggagaatggcgtgaacccgggaggcggagcttgcagtgagccgagatcgcgccactgcactccagtctgggcgacagagcaagactccgtctcaaaaaaaaaaaaaaaacaaaaaacaattctagatacattgagacctttgctcatgctattttcattgcctggagtgtcttctctctggatagaaaaatcctttccatacctcaagatggaatttggaagttacttccttgtgaaacttcctaatgattccaaagtcaggcctttctatgtgaaatttattttaccacatgctagtttaaaaaaacaaaacaaaacaaaaaaaaaaacagagcaggcacggtggctcacgcctgtaatcccagcactttgagaggctgaggcgggtggatcacaaggtcaggagtttgagaccagcctggccaacatagtgaaacgccgtctctattaaaaatacaaaaaatagtcgggtgtggtggcaggcgcctgtaatcccagctcttcaggagactgaggcaggagaatcccgtgaatctgggaggcggaggttgcagtgagccgagaacgcaccactgcactccagccgaggcgacagtgcaagacttcgtctcaaaaaacaaaaacaaaacaaaaaaaaaaaaaaaaaagaggaagcaaactatgggctaaacatgctggtttaaaacagttttgtctgaatccaccacatactatctagatggcgatgaaaaagttagttggtctccctgaggctaatttcatcatgtgtaaaatgtagttaataatagcatatataggccattgtgggggttaaataagacaaagcttgttaagcatttagttcaatgcctgcttccttgtaagagttcaataaacattagtttctgctactgaggctctgctgttacttatcgtctcctaacactagtttataaattcagtgagggttaggaaccatgtcttatcactttactttctttttctctatttaatctctagcagtttcttatatattatcgcagcatgataaatgatgctgagaactgagtgtgaggtagggcttggggtaggaccttatctaattaacatctgtgtatgcctaccatgaatattaaataataatactgacattccaaaatatacacatcaatctcaaaaatgtttaaccataactcctgtattccggtaaacacaactatatggcaatcttaatagttatgtattgcctaacacctgttattttttaactgcctttgattctgtgtaacattctcaataatttatcaaatgtactttaattggatatttacatactgcatactcttctcattagtaggaactagcaaatagacttactatcatttagattgtattctatgcttcatttaaattagtctgagagtttttggttgttgttagtgtgtatgtatgtgttttaatttaggcaccattttttataccttaagcaaaggaaatctgatcctaccacttctttgtttaaaccttgtcaatgacttacgttttgggcaagaaagagttttaaatgcttaatagatctatagaatctggttcctgcttacctcaggaaccatctccttcctcactcccacttaactccgtagtctctagtattctaggcctttttcatcttctttgtgttcctagaatatttaatatccttccaagccttccctcatactaccacaatactccttgtggctcttaccatccaggtttgagttttagtgcgtcatctttcaagaagcatttccagactcatggcctacccctgtcccccacaagtctattaagtctcccaaatatacattcttataacaacttaagctttgcagtcacacttttcttttcttttctttttttttttttttttttgagacggagtctcgctctgtcacccaggctggaatgcagtggcacgatcttggctcactgtaagctccgcctcccgggttcacgccggttctcctgcctcagcctcccgagtagctgggactacaggcgcccgccaccacgcccggctaattttttttttgtatttttagtagagatggggtttcaccatgttagccaggatggtctcgatctcctgatctcgtgatccgcccgcctcggcctcccaaagtgctggtattacagttgtgagccacagctcccagcctgcagtcacacttttcaaattgcaatttaaaaaatgttttgtatttgtttaatgtatattttccccactcaactgacatctccttggaaagcagtaaccttgtctgaatattcactactccgtcatcagcacctagaagatacctggcacatagtaggcatttaatcaaaatgtttgaataaatgagtgaagaaatcactctgctgggtgactaaggatgcaaagctaaactctgtcttcgaaggaaggataaaaagacagacacataaaagacaagagagtgaataaagaaagtgggtagagaaaattaagagtgctgagtgtacttcttatctctctaataactaccacatttgtgactttaacaggaggcttatttaaaagcattttttttatcctagctgactcagaccatttatggaaaagtggggtcattgcagaatgtttttatctttctggtagcataattacctcctctatgttaaaaactgaggactttggttcaaaatactcaccactgactatactatctttgttatattatttaaatgtcctatgcctcgattttctttctttcttttctttttttttttttattttaacaagatctactctttaggtagtgagagagcactaagaaaatggctactccaatggggcaggaggtaaaaaagagaagcaggggtacttgatatacttcggatagtacaaatctggtgattctgatccccagaagggattatggactgatatggtttgtctgtgtccccacccaaatgtcatcttgaattgtagtccccataatctccacgtgtcatgggagggacccattgggaagtgattggatcatggggacagtttcctccatgctgttttcatgatagtgagttctcatgagatctgatggttttatcactgtctggcatttcccctgctggcattcattccctcccctgccaccctgtgaagaggcgccttccaccatgattgtaagtttcctgaggactccccagccatgtgagactgtgggtcaattaaacctctttcctttataaattacccagtctcaggtatttcttcataccaacatgagaacagactaatacatggacgtaaccccacattgggtgtcagaataacggaaaaggtgtaaaagtgaggtgactgattctcctctggaaggtttgcagggaggctgtcctagtgggctgccaccaggatagttgctactcacctgtgtcctggcctggtcctggctgagtcctcacccaaactgctctgatgggtggcagtaatgatagccatgcctcagttttataatctgattttttttttttttttttgaaactgagtttcgctcgttgctcaggctggagtgcagtggtgcaatctcagctcactgcaacctccatctcctgggttcaagcaattctcgtgcctcagcctcagaagtagctgagatgacaggtgtgcgccaccacgcctggctaattttgtatttttagtagaaatggggtttcgccatgttggtcaggctggtgtcaaactcctgacctcaggtaatctgcccgcctcggcctcccaaagtgctgggattataagcgtgagccaccgtacctggcctataatctgatttttaacagaatttttttagtctatatcttgaactattttaaagtattatgttgaacccaaatgaaaattaatacatgcattccatattatccttgttaatgcttcatatttgtaaatacttgtcaatgcatattcatcacataatgtgtggtttgtaagtttcacatattttaatattatttttaaagtacatttctttgaaatgttaataatttctaactaaaaattatccaaattaaatggaaaaattcatgttttgtttttagcattaagaggaatcttttctgacaggttttaaaaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggcttttaaaatgaaaattataagtaactaaggtactacctatgaagatgaaaaattgtagcaactgatttgactcaagtatctatgagctctataaactcttcatttcccagtgctctgctaatgcttattctaattctaatggaacatgttttttgtggtaacaattactccttacatcaaaattaagtaaaatgataaacagttttctacacatagcattgatgaagtgatcctactttaccaataggatcagttagagggcaagggggtataacacctgccttcagctacctgaaatagtcaaaaccaatataaatgtacattaaagtataaaggaaataacttactttctattttggtataagcttatggaggaattacaactatctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagtgtcctgttctttgaagcttttgtagttgttgtcactctctcctgtggcaccaaatgccaggaaatctgggtattcaggagcaaatgccctttggctgctgatcgtaccagtgccttcagtagtttctcagggaactgtgttaggagaggttctagcattagttatatagtgtgtccataaccagctttcccgtgtcaccctaaatatggccataggcttctccctcagtgctgccaaaacacaactaagggcaggctgcctggccgagtcacaccaatcataatggtctacaatacactttcttaagtctcagttatattcagtcttaaccccaagtgaggagtaacagtaacccagatcaaatctctactgatgaaacaagctttctcctccttctccatagacaaggtcctgttaaagatatacccactttatattataaatagaaatctacaggtagctgtaaagataccttgtatctctacgacatgaaaatgtcattctgtttctagaatcaaaactgcctgtaagccaccaaatagccttgctggttttttgttttattgttttttttgtttttttttttttttgagatggagcctcgctctgtcgctcaggctggagtgcagtggcatcatctcggctcactgcaacctctgcctcccgagttcaagccattctcctgccttagcctcccgaatagctgggattacaggtaccctccaccacatcctgctgttttttgtatttttagaaaagatggggtttcaccacatccaggttggtctcgaactcctgaccttaagtgatccacctgccttggcctcccaaagtgctgggatttcacgcgtgagccactgtgccctggcaattagcctttcataaaatgcattttatagtaagtttttttttttttttttttttgtgaggcatcccactacatacatttaagtcttatttctactgggtatggtggtagatgcctgtaggcccagctactcagaagactgagatgagaggattgcttgagcccgggagttctgggctataatgcgctaggctgattgggcatctgcactaaggtccacattaacatggtgacctttcagtaacgggggaccactaggttgcttaagcaggggttacctagcccaggtcagaaacaaagtaggtaaaaactctcatgctgatcagtagtggaattgcacctgtgaatagccaccacactccagccttggcaacataacaagattctgtctcttagaaaaaaataaaaagacttattttctttaaaccgtattcttaatttctattctctaatataggagataaacaaaatggccagttttaaattttatctattgtattagggttctccagagaaaaagaatatatatatatttcttttttatataaaataagaatattttatacatctatatatagagagagagaattatggaggctgagacatcttgtcatctaacctccaagcttctgcaagctaaaaaaccaggaaaactgatggtatagttccaatacaaatccacaggcctgagaaccaggggagccaattgtttatgccccagtcccagtcccttggcccaaaaaccaggaatgtcaatgtcccagggcaagagatgatagacggctcagctccagaagagagagagagcattcacccttctccactttggtgttttatcttggccctcaacaaattggatcatttcccaccctcattgaggagggtgatcttctttactcagtctactgattcacatgcaaattcttccagaaacaccctcacagtcacacccagagacaatgtttcaccagctatctggacatcctttaactcagtcaaattgacataaaattaactattacatctactaaaatatctactagagcaacattcaggtctaaagacacaaacttaatttaggctgaccatcattctactgataaacatattcactattacatatatagctttaaaataaatatgattgaagccaaccttgttattaaaatgtatttaagatgttcagattgatgaaacgaggggattaaaatgcgttctcaaatacaatgaaatagtactgtaaaaatattctcagtaaatgagttttgctgtgaaattggtttaagattcataaaagggatttcaggtttttaagtactcaagtcagcccatgacccagccttcagtggtgtcatcctatgcagtgttagaatgagcctttactccttcaacaaatatttcttaagaactgtatagcttactggttaagaacatgggttctggaggcacactcagtttatttccatttttgtgacatactagctgtgtgaccttatgcaattatttttttatctcagaaagctgttgtgaagatgaaatgagttagtccatgggaagtcttccacagcggctcacacaatttattttttaaaaaggttaggtacagttacattgtcgttattgttgattttcatttcttttgttactgctactatttcttctctgtgccaggcgcacgtctaggtgttgatgagtcagtgatcagagaaggtctactttcatggaccatatttttaagtagggaaaggtaggcaataaacagattgaaataagaaataagaaaaatagacaaaagagataatgtcagatagtgattaagttctcagatgaaataaaataggtcagagtaacagtgatggggatggatattttagattggatagttggggaaagcctctatgaggaagtggcatttgagctgcgactgaatggcttggtgggaaagaaacagtctaggcagagagaacaagtgcaaaggccctgagttgtctgtgaccttggtatgttgaaggaacagaaagaaggttgatgtagccaggcatagtactttaaagggagaatggcatgagcttacattgcagggatgggtagcggacaaatcatgtagagccttgtaaatcatgggaaagactttggattttcttccaagtgttgtagaaagttattagagggttttcagaaaggaatttacatttgaaatatcaacagataccattttttaaaaaattcaagtagagatgatatgtagacagttgattatgaaagtgtgtgtctcaggggagagattgggataggagagatataaatttgggcgtcatcaatatagatgatatttaaagctatgtgaattgctgaaatcaactagacagagaatgtagatagagggctcaggaccaagccctctactctaacattttatagaagtcgccagaggaatccaggcatggtggctcacgcctgtaatcccagcacgttgggtggcccaggcgggtggatcacctgaggtcaggagttcaagaccagcctggccaacatggtgaaaccccatctctactaaaaatacaaaaattagctgggcatggtggcatgcgcctgtaatctcagctacttgggaggctgaggcgggagaatcgcttgaacccgggaggcggaggttgcagtgagctgagatcatgccactacactccagcctgggtgacagagtgagactctgtctcaaaaaaacaaaacaaaagaaagcaaagcaaaaaaaaaaaagaaagaaagaaattattaccagaggagaggaagtgagaaagaaaacttttcatttctgtgtcacagaaattaagagaagtagctaaatgtgtcatatgctgctgagacctaaaaagaaaaataaaggagttaatattggattttgccacatgaaggtcactattattgtaaacaatacactgctatatgaaaagaactagatatcatgccatggactattacagtgtctacattctaaccctaaatggatgactgccttttatctagctcccacaactctaaaatttgaatggtaatattgctctgcctttttgaaaaggttgttataaagaatatgggatataatggaaggaaaggtatataataagtgataaagtcttatacacatgcaaatcgatggtggtagaattatttgtactattagattataaacttcttcagggtagagattaaggctttaatgatcattctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgggtctattgacacaaaaatgggcttgaggactaaaagatttaatgtggcttgtcagcatgaaagaggctgttgtgttgttaatgtgaatgctaatacttacgtagcataaaaaaagaacataggaagtgggcatctcacttttaaaatcatggtgtattccataagtgtcagctgcaaagtaactttccagaaatggtctgatttccccattgacttccattatagaactagagctgtgttcccatggaaaataaatttggccccaggttataataaaacacagtgaagaattcagaaaatcttataaagtcaagtttttcaaggcacaattatcagtacttgataaaataataacaccacaaaatattaatactctatagtagatcttaaaatagtatgccccagactgcaccattatttttctatacaattccaagtctattacttttgcatctagagaaattttacttctgtgatcattattaatttttaatggatttaactctaatttaaactgttgattttgtttccttttttctttatggttagtccacttacctttttctaaaacattcttatctatgacaatcaaaagttactagccatagaagaaagaccagaaggaaatgctccaaaatgttcacaatacttgtttctgagtgggaaattttagttgatttaagtttttaatttctaagttgtaaaaaagggccatttatatcttctataatcagaaaaaatgtattataatttctataagtataaatttatatatagtgagatatctttagtaggacacatttatatatttggttcattttatgatttggtaatggtagttgttaagatcatttattccttcaaaatttttttaaaactggtaaaattagtttctggagataatagcttctacttaattttctagaacatactactcaaagtgtgggcctggaccagcaacatcagcatcacttggaaattagttggaaatgataattcttaggcccctgatctggggccccaggaaacagctatttgtgttttaacaagccctttgggcgattaaggttctaaagctacagaaaattctctctagagctacagcaaattttctttacctctctctccttctcctccctctccctctgtgtccctctctccctctccccttcatcctctcttctccctccccccttccctccttctccgtcttcctcctttcttgccaggccacttcctctcctttatagaggaaaagtagtttctcttctcacccattgctgggtttgtagctgagacctctaaaacaaaagacagattaacaagaggaaaacttatggatttatttaatataagttttatgtgacacaggagccctcaaaaatgaagaccaaaagaaatagggaaacttgtatatttttatgattaggtttgatgaagagtggacagtagggaaatataatcaggcaaagggggtatgatctaatggtaatgagctgggggaacttagcaaggcatatttgttcagattcttctctgtgtccatatgtctccagagataaggacattcttttccttcaggtataggaggagcagctctgaaatgagggtcttataacctacttcagaggcagttaagagaatcattttcttgcctgcttcaggagaaaaggattagaagatcagagagaacttcctgcttttgctgatttctcaaatgccaaggtgccatattttggggaagtgtgtcttgaaccccatcaccttcttccttctctgtttcctttcctcatgtgggttatgcatatatgtatacacacacacatatataacactcatatacagaattcactataacctctttttttttttttttttttttgagacagagtctcacactgtcgcccaggctggagtgcagtggcgcaatcttggctcagcacagcctccacctcccgagttcaagcaattttcctgcctcagcttcccgagtagctgggagtacaggcgcgtgtcaccatgcctggctaatttttttgtacttttagtggagacggggtttcactgtgttggccaggctggcctcaaactcctgaccttgtaatctgctcaccttggcctcccaaagtgctgggattacaggcatgagccactgcacctggcctcactataacctctatctctacttatatagagatgtatattaaaaagagagaaaaaaaaatatatatatagttttttctttaagttttttgccactgttttctaccttactcataaaaatatatgaggccgttttctggtatttatgcctatatgctttcatttagcaaacattttctaacaaatgttccgtgtggctacatattgaatagttctgcctaatttaaagatcttcaagtctcactaaccaatataatgactctatcaagttattttgggctaaaatgtgtcttccccaaaattcatatgttgaagtcctaaccaccatgtacctcagaatgtgactatatttgaacatagggactttaaggaagtaattaagttaaaatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttgaggatcacagtaaatattagcattaattgggggtggcaattagggtacaagttatgatgctaaaaggaatcaaaggctttgctatataaatgctatggaaatacacgtcctctgcatctaacaaaggagtagcaggaagagcacagactgattgcaatagtaacagaaagatatgcataatagttgatatcaaacaggtaaaggtgtgtgtgtatatatatatgtgtgtgtatatatatgtgtatatatatgtgtgtatatatatgtgtatttatatatgtgtgtgtatatatatatatatattttttttttttttaattttttttgatatggaatcttgctctgttgcccaggctggagtgcaatggcgtgatctcggctcactgcaacctctgcctcccaggttcaagtgattctcctgcctcagcctcccgagtagctgggattacaggcacatgccaccacgcccagctaatttttgtatttttagtagagatggggtttcaccatgttggccaggctggtctcgaactcctgacctcaagtgatccacctacctcagcctaccaaagtgttgggattacaggcgtgaggacctctagcaataatccccaacaggaagatcagttaacaaacaaattcattccagtgtgaggtattcccaaagcagtactttctttgtattcccaaagcagtactttctttgtcaatgctgttgccctgtgaaatcatttgattttggtgtgacttcatctgtgagatatgaatatgcttgtggaaatcaaattgctttcatctcctaacccagggcctataacccagagcatacccgaacagttaaacaagcagctttagtcacagaagttaatccacaaacttccagaagtatgatcatatgtcttcttttttgctgaaaatattagttgatttttgtctttgacccttcatagagacacatactttttagctaacccataactagtagaatgtgttctactggcaatgagaagagggctaagagaagtagtcaaatcattttcaaaacttaaaagctgattatatgctatgaacacataagcgcacaggttatatctacttggattattttcaaaaaggacaaaacaatgaacattaaaaaggaatgatgaccagaaaatatactttagttgacacactgaaatgataaatccaataattttttttgtaacaatgtctgtgggtgaatggatatataagaatatgtatgtggctaggcgcggtggctcacacctgtaatcccagcactttgggaggccgaggcgggtggatcacctgaggtcaggagtttgagaccagcctggccaacatggtgaaaccctgtctctactaataatacaaaaattagccggtcgtggtggcgggtgcctgtaatcccagctacttgggaggctgaggcaggagaatcgcttgaatctgggaggcgaaggttgcagtgagccgctggagacagtgagactctctgtcccaaaataaataaataaataaaagaatatatatgtaaaatatataagaatacatatgattaatattgttgatctccatttagatcctaaaacactgtctgtcttattatatgttcccttacctccccaatacacagacacagagtagtagatggtgtacttgcccccccatgttgcagcattcttctaataattccagtgttacagcctgtgtgtactcatattagccatatgcctagaaggctaagaactctacttgtatcacttttcaatcataacttgttttttaaaaatgtaagaatattattgttaacgagacctgattttgtatcctggtactgccactaaaaagctgtgtgactttgagtaagtcatttgtcctttctagctatccatttctgtctgtcttttgtaaaatgaaagagttaaaggattgatctctaagaattcttttccctgttagtagtctgagtcacagttcgaatttcagagatggcagagtcatatatattacatacatatgtaggatatgttttatgtctttctgctgacttcactgcacatgtagcttgagtacagagtaagaatttttcatatattgtcactgaatgtaaataatttgatattcttatgtccagtttcatgtccatttaagttaatttcttgagaacctgttacgattaactttcaaaacaagtaatcagatcctaaatgtgtcaaccaatctgaaacacttacctaatgcactcctgaccagccattgctatctttgccttatataacagtactgctaccacttctatctacaaatctttatcaacttgctgccatgagaattaggtgtgcaacgtattaactgttttgaacgtgggtgggacatataacctctctgggcatttgtttccttgtctataaaagacggaaaataatttaagccatgtcttcctcactactatctgaaaagaccttgaaacctatgctatacagatgtagaatattattagccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcgcggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggcatggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattcttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccctgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcattgcccttaccagcaatattacctagtggcgtgaggttaatttaaggaccaccatgaccactaagtgctatgttttcatacttttccacacctcatcagtgctcctttttttgtttgtgttgctcggtttccattcatttttgatgttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgaagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctatcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacgcctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgaatcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccatcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggagtgcagtggcgtgatctcggctcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatggggtttctgtgagtttggtactcaagggaatatagtgttgtcaactgtgaaacaccaagaatatattcacaaactgcataattttatagtactgattccaagtaatctaaattgggatttcctttggtttgtagctggagtgcctccatgaacacatagggttaaaaatatcactcgatttagctgtggcagtcattccaagtggcagcagccaaagcaaatgtccagaggtaaaacgaaactcgaatgcagacagtggcagtggttgggaagcaccttggtcatcagtagaagagctggaagtgagggagtggggacagaaggcacagagtttacaagtctgccaaaaaactctgtctgcctctttctggaagaagcagaaccggggacttttacagatttcctccttgcctcagcccttcctagctagatcatcttttcctgctagtcccgttatttttactttcttaggcacctgatttgtttcctttccaagatcccattgacttggtattgttatactttccctgttcaacattgacattcttgatcttttccaacaacctccacttcagcatgatgagataaaagcagaaaaggctaattataaagaaggctatcttcccccaagtaaagtaaaataaaaggaaaatccaaaaaacactaaaatcagagtcaaccacaatcagcggagatgtacttactgctctgcttgccattttcattaccatcgcttatagatgggtattactgttatgtaaaatacagagctctaccattgtgtttctaattgtaatctttttatttattttttatttattattatttttttgagacggactcttgccctgttgcccaggctggagtacagtggtgcgatctcggcccactgcaacctccacctcctgggttcaagagattctcgtgcctcagcctctccagtatctgggattacagggacataccaccatgcccagctaattgttgtatttttattttatttttatttttatttttatattttgagatagagtcttgctctgttgcccaggctgcagtacagtggcatgatcttggctcactgcagcctctacctcccaggttcaagtgattctgctgactcagcctcccgagtatctgggactacaggtgcccgccaccacgtccagctagtttttgtatttttagtagagatggtatttcgccaggttggccaggctggcctcaaactcctgacctcaggtgatccgcccacctcggcctcccaaagtgctgggattacaggcgtgagccaccatgcccggccaaattgttgtatttttagtagagactgtgttttgccctattgcccaggctggtctcgaactcctgacctcaggtgatctacccacttgggcctcccaaattgctgggagtagaggtgtgagccactgtgcccggccatctaattgtaatgttttaaattttatatgtaaacaagatgaggtgatagtctgtattcttcattagaaaatcaaaatgttaataaatgatatgattagttgcctaaattataaatcgcccactctgagcctgtgccccctacccaagacctaccatatttagtaactcagaaggagcttccacatattgcctccagcccattcagcggatgtgctgtttcagttaagtaccaaaaggcatttcaaggtagactatcatatcagtagtgataattgaaaatatttttttttaataaaaaacaaaaaggctgggcgtggtggctcatccctataatcccagcactttgggaggctgaggtgagaggatcatttgagctcaggagtttgaggacagcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagcatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgatccgcccgccttggcctcccaaagtgctgggactacaggtgtgagctaccgcacccagccgtaaggttactaaactattaagatcaagaaaaggagtggtgatagtagaagaaggtaaattcagttttggataagttaaactgaaagtgatagcagaacactgaggtcaagatgtccagaagatttttggaaatatagttacagatttcatgacaaaatgaattcttgagtgttctggatatagtgtggataggggaagggattgttatagggatttttaagagaaaagaaaaccaaagacagagacttggaaacaccttcactaaggggctaaaagaagatagacaaggagcaattgggcaggtaggagaatccagacattattgtcctagaaacaaaggaagagggaagtcctaagaagggaggagaggtgaacatttttgacaatgacatacgctctggtggaataaaaaagggtaaaaaaccgatgatttgctatttgggagctttctaatgactttttgaagagcatcctttcaatattgtgatggaactgggaagagaatacagagctatgcagagtagatggtgaggctatagggaaagatcatattcattcaacagttgagcagtcttattgaatgcctcctcggtgcattatactgagttaggtactgaggatacaaaatcaaacgggagcctagaggagctcacatactgtttgggaaaacacgaatataaaccatgtgatcaatttacaatgcggtcttctatatgctgtaatagagataggaacagtaagcctgtgcagcataggagttagagtaaccactcccaaccccccacctctctcctttgtgtctgtataatatgggctattctttctagcagtttggtgggtgaaaggtacatctcatttttccttcacaacctagtatggatttatcttctctgaattttgctaaatctttcttgatcctgtgttgttacagcctttgttaccacataagataataagttgcatacatttaccatctactttgtaaagaattgccctggctgtgtaattgtaagatcaaagataagctttggaggaaaaagaagcacatagagagacaccttgcaggagtgaaaatgactctttttttttttctttttttccttttttttttttttgagatggactctcactctgttgcccaggctggagtgcggtggcgcgatcttggctcactgcaagctccgcctctcgggttcatgccattctcttgcctcagcctcccaagtagctgggactacagggcctgccaccacgcccggctaatttttgtatttttagtagaggcggggtttcaccgtgttagccaggatggtctcaatctcctgacctcgtgatccaccctccttggcctccaaaagtgctgggattacaggcgtgagccaccgtgcccagccagaaaaccactcttaaaatacaaatacacaactccacatctgttttattgccaaatagctatagatacttagagcttgcttctctttcttcaaccaacccgacttttttattctttgcccactgtaagtaaatataaatgggcttctcagcaataggtggatatctaacttagcattttggctatgactggattttgatatatagttctagacattaaaaaaacacacaagagaagcattatgaagaaatgaaaccaggaaacaataaatgtattttggttttagaaccacacggggcaaccaagaaaactaaatttcaaaaatcaggagcaactcaggagacacatgatcctagttttatgtgtcagcaagataacagtataaatgagaaggtataatttaccatttgagaacagataggggacaagaaacaatgttatacaacagagaaaaagaaacctccgtatgtattagggaagaataatttcacagcaaaacaaaacccacatttccccaggcctcactgcctcatgtaaataagaaaactcaaattttgctggctcttgtctctacatacacattcagcacctcatctgctataagggatctatgaagcatttctgggagttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccaggcagcagtgctagggccttggagtacaaatatgggtcttgcccttaaaaactcagagcctcatgggaaagacatatgatataaatttcataatataagtgttcaaaaagtgctaaaaagagcaactaaccgcctggagaattcaagagaggcttcatgatgaaagtggcctttgatctatgtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacacacacgtaaatgagtttgaggctggagacagattttggggacatctgcacatatatatgtttattgaaaccttgggatcacccagaaaggacatctcaaatgagagggttgaggatggtacatttgggaattataatatttaagaggtaaatagagaaatcaacaaaggatactcagaaagaaaaaaaaattagggaagaagagaagcagtaaaaagtggtacctaagagctgggcatggaggcacgtgcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacagggtagaagagggtaggatggaaaaggtgccaaaaatgaataggagttgggcacagtggctcacacctttaatcccagcactttgtagagccaaggcaggaggatctcttgagcccaggagttcaagaccaccctaggcaacacagggcgaccttgtctctacaaaaatttttatttgaaaattagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatgggccaggcgcagttgctcatgcctgtaatcccagcactttgggaggccaaggcaggcagatcacctgaggtcaggagttcgagaccagcctggccaacatggtgaaaccccgtctctactaaaaatacaaaaattagctgagtgtggtggcagacacctgtaatcccagccactcgggaggctgaagcaggagaatcgcttgaacccgggaggtggaggttgcagtgagccgagattgcaccattgcactccagcctgggggacaagagtaagacttcgtctcacaaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggatcacgaggtcaggagatcgagaccatcctggcctatatggtgaaaccctgtctctactaaaaatacaaaaattagccgggcgtggtggcacatgcctgtaatcccagctactggaggctgaggcaggagaatggcttgaaccaggaagtcagaggttgcagtgagccgagatcgtgccactgcactccagcctggcgacagagcgagactccgtctcaaaaaaataaataaataaaataaaataaaatttacttttgggacagacatcacatgtattggctaataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaagatactcaacaggttgtcataagtaccttaaaatttctagaaaattaagtgcttttacaactaaaggaaaataaacatttattctaattggtggccttgattatgggaaagtttctctcatacaggctcatttctatattattaagtattttcctaaatagggataagaaattttaagctctgcttgctttacagcagaatccatctgctttcccagtggacatcccaagacaaccagatttacctggacatgaatgtacttctgacccttcaattttcattaaacctttagatacacctcttctgtgtattaaaatttgaaccttactcctggtagttccttttcttgttgcccattaaaatgagaggagtggaagctgaaagaaggaaggaagaaagcagtaggtatcttaagcgccacagttgttttgttttgggttttgttgttgttgtgattgtttgttttgaggtagggtcaccctctgtcacccaggctggagcacaatggcatgatcatggctctttgcagccttgactctcatgggctcaagggattctcccccacagcccctcaaccccacccccagcctcccgagtagctggaactataggctcacagcactgtgcctggctaattttaaatttttttgtagacagagtctcactatgttgcccatgctggtctcgaactcctgggcttaagcagttcctttgcctcggcctctcagagtgctaagattacaagcgtgatccactgcactcagcccacagaacccttttgagatttcagttcttctattatttcttggtatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtggatttaattctattgtcatatcatcaaccataaacaatcatgaattgaaaagaaaaaggactttaaaaagtacttttctagtacatagattttactttatggtccaaatttaaacaaactcttttgcacctggaagaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttgttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctagagatggtgggtggtgcgttagctctgtatgtaacagggaaaatcctccacaggctgtaaaatgttgaaagcacggttaaaataaaaacaaaccaccgttacattttttacggtagtttgggttataggactacaatgtggccaaatgaaaaggttttttaatttgacttgcgtgtggggcagagaatggcagggctttgttgaggctccctcccttgtttatttcttcccctccaaagcatgcctgttagatggttcttctttcttatcccatttcacttgtcattttatttgttttcaatttaaatatcacgctatttaagaaatagtcactgcttttgaagtttattttacagagctgtaagttttattgagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaagattgttgggaaggggtggaggaaggtagtattttcaattggttacccggcttttaacaaaacaattcctattataatcccagggaatttcatctgactaaatctccactcagacgacaagcaaggagtgagagctgcagccaaagggacaaagagtggggggaaccagtggctgaatgagtcccaccatggtgccctttagtgggtcccattgtgccgtgggttagcacttctcaccattgcttatgaaaatactcagcattgaataatgctgtatgtcttacattctactcactaaaattgcttatgcaatttcaattggctatggtatttatcatttactgtcctctgcattatatagcatggttaagcctaagaagcagctgccttttttttttttaagtggatcaagcgattgttatgtattgtgtgaatatcagttcaagtttcttgagtgctgtagcatctagatgaagggtagtaaataaacattaggctcttaaaataaaaagacttttatgcgattcttcaaattctacattgcctggaaataaatagtggctattggtcccttttattttaataaaatttagatatatccaccagctgtgagcacatataaatctgcactttaatgttaatggaagttaggcatgggtatcaagaggtaaaaatcctagaagatattataaaatcatgttatgtagctcagtttttacagtggttcgaatgtaaggggtattctacatgccataaattactatgtatacaatctttaacctacaacatccttgaataaatagctttagaatcataagcttggttagtttcttttaaagtatagggaggcggtgaatgtattttaattataaaagcctcttagaaaatctgacatggtaaaaggagctatattatgtgtacacgtatgtagctcctttggtgtttggtaagagcactagttgccactctagtattttttcccattgtctgctcaggctgttttcggtctgagactttctcatcccgcagcccccacctctgtataacttttgccctgagtccttcaattgcatagactcttttctttctcttttcatttctgaggtgaatctgggagcccttatgtcccacaatttactgaagtgctataattatggcctttatcttttattaacatacctacatgctatgcttttctgtggtagcccagaatattaatgcaattagcacccttcattaagatgtactgtccattttgaatgacagctttaagtcacaggataagcctcctatacaatgggctacttttttttttttttttaaaggaagaagggaagatttgtaatttttaagaagtgaaaacttctagaaaatctttcattgctaatcctcccaaaccacccaaaaaagagcaagttttgacgttgaaacttcaggaaatcttcatactgataggatcttttccacactttaaaaagttaatccttaagttaatcacaatgaagacaccctgcttatttcctacagtggctaagaagataaagtgagatggtgaatgtgaaacttctttgaaacttttaaagtgtatttatttaaaatttgaatagagctttaaagtgtttaaagattattatcaatactatgttaaatcaatgccacttaaacccttcagtatcttcccatttcttctaggagaaatttaaattttttacagtagctcaaaaggctctgtgtgatctgacatgtatgtacattacctgccgcatctccaacagtccaacgctgtgagaaaatgtgatatccattacatttgaaccacaagactgttgttatattagaaagggaagcattgttttggtgcagatatcttctagtattcatctctcaaataagtctttttggtaaaattaagcaggattttgacattagaagacatgatgccgaatttaagttgtatgatgattattttgatgttattatgaaaataagtgcaatgttattggtttcatttatttctattatataattgattaaaataatgaacaattaaaatgtaagcaatgatttatggggtgcttaactcatagcagtaaatatagtatattgaacttacagttgcattgcctgttagacactatcaatatagaataagtctgatattttctaaatggaacaattagaacaaaccttattttaaagtgtgcctttccccatactccatgttccaaataattataagaaaacctactgcttctgttattacacgtttacaaagcaatagaaatattgcctgtaacctggccttcatagttcaactttagacttctttttttatgactacatctatactgtggaaaatgttttattttcctaggtaagctatgctattgtagtaaaatttttgaaaggaaaattattttggatcaaggacaagcaactctagcagttcagttgtttttttatctcattatttttcaatctaggaaaaatatttaaatatataacaccaatattttgcttggatagattgaagcttcagatgttttagttagaaatggactgcaaaaataatatctcttaaaaaaagaaacgaatatagtcaaatatgtgtctaagaaatacaacttgtgcatacatcctatagtatctctataaagatttcatcttgtttttctgattgaagtgttcattactagagacaaatgtatttttaagtcttgtgattagagggggccacagccatcatagctctattagaggcagaaatataacattaatattttagtgtttcatttgctttcatgaaacttatgaacagaagctatcagtgtctagggtttatcttcaaatgacaaatttagcattctgtaaaaagtgatactaggacttcctgctgaggtcatctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattacatatccctcttgtcttccttcttttcttggccaacttctttgaagtgtactgccatcatatatttttctcttttaaaatgttttccattattaaaggtaatgtatgttcattgtagaaaatgtgggaatgtgtaaaatataaagacaaaggaaaatgcatagtctcaacatccagaagcaaccacctttacattttgtttttttcttctatcttgtatttctatgcatattttacattgttcatattatactgtatacaaagttgtatatactacttttccacctaaatttataagcatttttacattaatgaatatcttgataagtctccttttaaatggttgtatattatttgaacgtaagaatgtatgatattcactccatccatcccttaaattagaaattgaatttgtttctttttttttgctaccataaataatgctgttgtaaacatctttctacatatagtacatatactatatgtagaaaatcagtacagcttttccctagaagagattcagaaagtaaatgacatgaggattttttactacttactagatgcaaagcatgattaacttgggtcaagtcagtgcataaaatctgtaatcactgatttgaatatactatatttacattctttgaacaaatattttaatatttattatagccaaagcctgatggtacaaagatggaccttaccccaaaggaatatactgtctagtatgaaaagagaaacacaataaattaaactgttaggttgagccatatgacgttgttgtttgacctatgaaaatatttatttcatgtgattcaatttaaaataatataggatgataaggataatattgaagcaagtacatggtggcttgggaacacagataagtaagtaattagatcttccgaagagagataacacagattattgctgcttattcagcagaaataaatttaaacgagggaacttttatatctgtgtaggtgtgtattagaaagctgctaggtcaggctcatgcatcagatttatggtattctgtaacattgcagcacaggaacacttcacctctctgaaagtccactcttccagcaactgtacctacctggaaatgctatctatctcttcaaaatatggcagtaaacctgaaagtaagcaaaaacaaaaatatccctcaacaggcgaaaggaatgtgatcaagtccttaaaaagcagcatgtagacttttatcaaaagagagtcttccaagtaccttactcaaaatctatttattatgttagacatagttctatcaaattggattttctatttttttcaccgtccagcaaatgggaaacagcatacataccaggattgagaggtagacagatactttaagactcactggaagcactaagacgtgatagttaatatcttgactatagtggaagagatgaaataattatcaaagcagataatatcttaaaaaacaaaaagcagaatacagactgtataattggtctcaactatgtaaaaaaaagaaataggtatatatatacgcagctgctaattaaaaaattggagtgaaatacaccaaaatattaatagtctttgtggctataccatggtatatgagtgatttgtacttccttcacattttttacaatattcttcagtgactctctgctgattatatcattagaataaataaaataataattggctgggtgcggtgactcacgcctgtaatcccagcactttgggaggcctaagcaggcggatcacgaggtcatgagatcgagactatcctggccaacatggtgaaattccatctctactaaaaataaaaaaaattagccgggtgtggtggtgcacgcctgtagtcccaggtactcgggaggctgaggcaggagaatcgcttgaacctgagaggcggaggttgcagtgagccaagattgcaccactgcactccagcctggtgacagagtgagacttcgtctcaaaaaaaaaaaaaaattaaaattaaatttgtaaatgaaaaagatctttgagcatagaacagttttggtctatttagagaagaaacaaatagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacctccttcagaatcatgcttctttccttcttaatgtctttctttaaattgacttctttctacagaaatgctcatgtcctccttgaacttaaaagcaatcctcaggccgggcgcggtggctcacgcctgtaatcccagcactttgggaggccgaggcgggcggatcacgaggtcaggagatcgagaccatctggctaacacggtgaaaccccgtctctactaaaaaatacaaaaaattagccgggcgtggtggcgggcgcctgtagtcccagctactcgcaaggctgaggcaggagagtggcgtgaacctgggaggcggagcttgcagtgagccgagatcgcgccgctgcactccagcctgggcgacagagcaagactccgtctcagaaaaaaaaaaaaaggcaatcttcagtgataaaccaaacaataaataaacagagtatgtccctaagttactatcctatgtctagctggggagaaaagacatggacacaccaaagaagtaagagataagatatgtatataacaatatttgtgtaccatgtatgaatttgcaggcactaatacccattgatgagctctatttggctattgggactgtgcctctcctaattgtgtggcttggttggaattgcttcatctgatgtggaacctcaatagtcagtcaatgatttgttgtctctttacttattcactctttattttgaaattttcaagtatatacaaaatacaataatataaaaaaaactcatgaacccagcttccacaatgatcaattcatgatcaattttgttttctccatactgctactcttggatattttgaaacagctctcagacattatgtttttttcatctgtgaacgtttctgtaagcatccacaaaagatgaagactatttctaacgtaaccaaatactattatcatatcttactaagaaaaaaaatccttaataacaaatatctatttagtgtttacatttccctgattatctgctttggtttttttgttttgttttgtttttttgttttttgtttttgagatggagtcttgctctgtcactcaggctggagtgcagtggcactatctcggctcactgtaacctctgcctcctgggttcaagcaatcctcctgccaaagcctcccgagtagctgggattacaggcacccgccaccatgcctggctaattattgtgtttttagtagagacggggtttcaccatgttggccaggctgttctccaactcctgagctcaagtgatccacccctctcccaaagtgctggaattacaggcgtgagccaccacgcccagccaattatctactctttttggttagtatgaattggaaaccaaacaaagttgattcattattatggttctgttaagtctctttttaacaatggaatcccccttgtgttaattatcaattattcatcaattgctgcataacaagttacctttaaaacgtagaagcttaaaactacaaatgtttattatttcatagtttctgtgggtcaagaatttgggagcagcttagctgagtgatcgtttcagtgtctctcatgagattgcagtcaagatattggaccgggctatggttgtctctgggtctgaggctagaggatctactccaagatcagttcttcactatacgggcctctctatagagcttcttgactgttgctatggtctgaatgttttgtccccccaaaatacatatgttgaaacataatcccaatgtgatagtattaaatggtgaggcctttggaaagtgattacccttataaaagaggctcaagggagcatgtttgctccttcagccatgtgaagacacctagaaggtacctctgtgaaacagggaacgagcccttatcagataccaaatttactggtgccttgatattagacgtcccagcccccagaactgtgagcaataaataccactgggtatgttgttatagtagcccaaatggactaagacaagcatctttacaacatggcatctggcttccccaagagtgagtgatctaagagagaaagcaaagaggaaaccacagtgcattctgtatcctagtcttggaagtgatataacaatacttctgtcatattctgccaatcacacaaaccaacccagaaacaatgtgggagggaattacaccagagtatgaataccaaggggttgggataattggggggattcatcttggaggctgactgctccaccttttcatctatctctcctttttttcttgtaattttcaggggttttttttccattttctttttctttcttttctttcgttctttttttttttttttctcaaaatcttgagctcaagcgattctctcaccttgacctcccaaagtgttaggattacagatgtgagccaccatgcccagcccagtttttattgttgaagcaaccaggtcatttgtctgattgagtttatattttgttcattgcatcccactgtgttatttacctgtttctttgcctgtccccctactccatatattttctgtaaatttatagttagataaaccaagccactctaaagcttgatcagattcaggttttgtctttttgtcaagatgtcctttttttgttggtgttgtgaggttttatattggagcacatgatggctagtttactctttttgttatattagcagccactgatgattctctagctccattagttcaaaagagtactattctattattcctcctttaattagtttgattacttcataaaaaaaatgccccctcatcaactatttgattacatgaaggtacatttcatataatgaagggatgagaagtacttctctctttttgtcagtaagttgttgtctctctagaatcctctaaaggtaacaagtgaggtctgggaaccaacatgggtatgctgaagcagagtctccagggataggtgctggtcatggggatcttgaaaacgcttcctatgtgattctaatttggtcctctattaacttctaccaatctccattcccagagtctgacttaggtatgggagggggccaaggattctgtttttgttttttcttttaatctctagatactcctcttcagctgacaagtttggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtaaccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgatattcattttgtctggtgctcttttctttctgcctaaggctttctgataaaatttatgctatatgccccttaataccgatttcatgatggttaaccatatctatgcctggaaagaaaatatagacttgggaagaaaacagatatatagtctacaatgaatatttctagcttgcattcaagatgactgtgttgtgcagaacattctgccaggcattaagtgggatacaaaagcagtctaacatatgatctctgtcctatgaatgtgtttttaaaatgtatactagtcattattggagtgactattatataaagacaaaagccactagggtagccatggttttttgccagttattagccatatatagtgcgtgcatgcacacatacacacacacatacatatatgtaatatataattttagtatatttaaattaatccatattttcaagaacttcattaacttgaacactcagaaataccctgagtgttttaagacataattgcaaataactcatgtaatgcgtatatttttatatctttgcatgtatgaagtttatacattcaggcttgtgcaaatgtgtttatatcatttgcctaagcccttgattatttacatgttcctatgtgggatcacagtccttcagatatgaatcatagcacagtgatttctttacatattcgtattctactattgagatactttaagaatcctgtgagttgtgtacctggaaatataaaattgatattattattaatccattcagaaatcatattgggcaatagcactactacatgtacatttagtagcaaacatagatagaatatttggagataatgaagatttcaatactgtgttaagaaaaaaaaaaaaaacaaccacgcaagagactcggctcttggctctcagctccaaagcatgtgaaatattcaacttaataagaacataactgcaggaagcacttctaggtcatgggagttgctatgcacaaaagaggtatggttgttctagctcagagaagcttccacatatattatttattgaggaagcctcattttaatgctgtatagagaagcccgaatgacatactcttcacaagtggcagtattggtattacagcattccaagggtgtgagacttagtttggaaatgaactgagaaaaagcaaataatatttcttaactattgtagaaaatggaggtgtcgctaggaaaattatattttcctctggtctttctcaccatttatttattccgctcaccaaggaccctggcttttgaggagaggtccatggctgagagaacattaaaaggaaagagtgaaagtggagaatgcagatgcatatttggattcaggaggaaggggaggttcaacaggtgccttctatagcagagttggttgttaagtcacactacccacaacatgctacccacaataaccacagaagaaaggttacacatacataggtctgttctcccttttatgctcacttaccacacaaatgacatctttgtgcctgttgttcggggtcattgcctaaaaaagttgagttgaaactggcaatgaagaaagaatgggccgggcatggtggctcacgcctgtaatcccaacactttgagaggccaaggcgggcggatcacctgaggtcaggagttcaagaccagcctggccaacatggtgaaaccccgtctctactaaaaatacaaaaaatcagccgggcgtggtggtgtgcctgtaatcccaactactcgggaggctgaggcaggagaattgcttgaacctgggaggtggaggttgcagtgagccaagatcgcgccattgcactccagactgggcaacgagagtgaaaatccgtctcaaaaaaaaaaaaaaaaaaaaaaggaaagaaaaacacagaaagagtggaggactttaacatttcttgagtacctattgttttcctggcatgttctaggtgtcatatgtacagcatctcattgcatcttcacaacattcctgagcattaggttttcttttcccaggtttacaggggaagaaatggaagattagagaagttaagtagcttgggcaaggtcgcagctggtgaatggctgaatcagaatctgaacaccagtttgtctaattctatcctgcatgctatttccttacaatgttccctttcacttaggggctcatgcaaaagatttatgatttccttcagattttctttggtcatagtgctctaaacacttgtagctgaatttttagttcttacctcaaataagtctgataacactactacatttttaaaaaatgagtgatataatttgtagaaatagtcactggaatgcttttaagagatttcaaatcatagagttgaaaattcatgctgtgctctaggcattattgatcctgagccatctcatgcaggtagatataaatcctcttcttaaagatctctggtgaaaaaacactttcaggcttttccatagtaatttacctcattgctgaaaatgtttacagataggtgtatgcacattgttaggaccaatgacataatgcccagttgcagtgaatcaagctaataaaataataatcctttttaaaattataatcttcaaagggtttccgaaaatcacttataggaagtttatgtgattttgctgtttctctaggaaaggcagttacgtttgaatatttaaatgatcaggccttgtgtgggtcacacagggatttttattttgcatttggattccctttatggtttaaatcacagatctctaccttaaatgcaaatgaatggagtgttgagaattgacataattttttaaattgccatagttatttccagggagctttatacctcagtataagtatcttatcctgtattataattgcttgcttgtttgtccttctaacaagaccatgagcaattggaggacaaggattgtgccttactcatcacagtatctctagtgtttagcataatgcttgacacacaggagtgatcaatagttatctattgagtgactgaattaatttctccaattgattctgcttagacaggcctttctcctacattcccccaaatgcaacctgctaattcacatttctctatcctggtttatgttatttctctcaactggagtgctctttccttcttttctccacttatataagtccacctagttcttcctggtacaactagttgctacatgagtcctgttctaactattccagatctcatagagtcatgtcctcctcatgccttgactcttttagcctatgggatgccccacacactttagccctttattatgtgcagctttatattatttgccaatttaaaaaatatttttgtcttgttttcccaaccattatgaaaagtagccatgtgttgtatcattttctctccccttcatagtgacttaagtgtggaagagaccgttggataacaaactatggcctataagccaaatccagtccaaaacctaagaatatttcttttttaaaaaattaattaattaattaatttatttttgagacagagtcttgctgtgtcgcccaggctggagtgcaatggcgtaatctctgctcactgcaacctccgccccctggactcaagtgattctcctgcctcagcctcctgagtagctgggattacagacgcccgccaccatgccctgctaactttttgcatttttagtagagacggggtttcaccgtgttggtcaggcttggtcttgaactcctgacctcgtgatctgcccgccttggcctcccaaagtgctggcattataggtgtgagccaccacgcccagcaagaatatttcttatgattttaaatggtaagaaaacaatcacaagggctgggtgtagtggctcacgcctgtaatcccaacattttgggaggccgaggtaggtggatcacttgaggtcaggagttcgagaccagcctggccaacatggtgaaacctgtctgtactaaaaatacaaaaattagccaggcgtggtaccaggttcctgtagtcccagctactcaggaggctgaggcaggaaaatcacttgaacccaggagacagaggttgcagtgagcagagatcatgccactgcactctagcctaggcggcaaagggagactgtctcaaaaaccacaagaaaaacaatattttgtgacatgaaaattatatgaaattcaactctccataaataaagttttttgcaacattgccacgtttattcatttacacattatttatgcctgcttttgggctacagcagtagagttgagcaattgtgacagagactctgtggcccacaaagcctaaaatatttactatctgaccctttacagggaaagtttgccgactgctggagtagatcatcaatgagtacttactggttaaataattcattgtcttatgactctattctattatgaaacaagatagtctgaaagtactgttaattatgctgtcttgccttacataaagaaaaatagtaataaaagcaacctctggagaacagattatttttatcttttagttggtgaagtataaaaattttcattttctcattctctggtaaagtgacttatagtgcccttattagttttaaaccttttcaaatatgcagaacctcttcctgcagagattttaaagaacagggtaaggccaggcatggtggcttatgcctgtaatcccagcactttgggaggccgaggcgggtagatcacctgaggtgaggagttcgagaccagcctggctgacatggtgaaaccctgtctctactaaaaatacaaaacattagccgggtgtggtggcgggtgcctgtaatcccagctactcgagaggctgagacaggagaatccctcgaacccaagagacagaggttgcagtgagcagagatcgtgccactgcactccagcctgagtgacagagcatgactccatctcaaaaaaaaaaaaaattaataatagtaataataaagaacagggtagatgattatcgttctgggatggactagataacttctagtattgtgcagcccagtgattccttgaatctcctctaaatgtaaaccttgctttattagaaatgagaaatctgatttgtggatatgaagtctccgcatcccccataactccttgattctcctttgccaggacctccccccaccctccacttttggtttaatctagttcttctaattaaatatgagataattaaagttcacagagtttaaacccagcaggtttgatttaatgataaaaatcttggtttgtcagcttttcaaggcataatcctggctgctgccttatctgacaggtagtcagcctagcaggtctgaggatgaaaaccagagcatctcatcttttcaggcatgacttgctatttatcttctgaggcataatttacaattgccctatagaaaatgggtagggttaaataagtagaaaaggtctccttttgctttggctcaattaattcatttcctatgcggttgtcgatgactaggcttacaaagtagacagatgtatttcaaatgaggagaaaatgccccaaacatagcatatttgattattgtaaattattcctttactcactgaatatgtaaagtatgtaaatttagtcctgctgtcaaaaggtagctctgtaccattagtttctgcagcagacaaggcctgctgcatcctgtactgcattttcagagagataattctaatgacagcttgagcaattgccttaatgagccagaaaggtgttcttttttattcgtgtttagctgcttagagtcatctgaaatagagatcatctgtagatattacagagtgaaaaaagacatgggttatcttattaatgtgtttctccaagcatgctaagaatgaaccatcaatcaggtatttgccaagaaaatagcttgttgtcagttctgtataggtgatatggcaacctgaaatgcaagtttaggttctaattatcatgctagctaagtaaaagagttgtcaagttgcatctataagtcattttgggaaatattgtagggcttaccaaattgatcacaaaatagcattaatattgtaaacctgaagtgaacaacataaccagttttttaaaaataaggcactctacttgagtcatcaggaaaacattagaaatctacctatgtgcatcatattatatgtaaaatttagtttaattggagctttgtgttgttagaacccaacacattaatattaacatttgagacaaatttcctatcatctgagtctttcattctaagtgaaatgtccatattttctcattaatttgggtctatttaaagatcagtcacatcacagtaacataaagattggaaaagtaatgttcacattttagttaaagtcatgaaatatatacctataattgactatggtgttttgatttggttataaagtatagctgtaccttccacacggagttaagagaagtcctggcttaacacattagtggtagaaagtgtaagtttacacttaagccactccccagccaaggatttgcataaaaaatgagtgaagttcagcttgggtttatgttagcaaaatggcaaatgtagaggcacgctaaaggtcctttctgccacccttgtatacaatacatgtctgcatcttgcctaatcttaattaaatgtctttattaaatctttattaaattaataaaatgtcttctgggtctgaggactgaaattctgaaatgtaaccaatatttaagagcttaaacagtgcttctgtatagaacttgtagtatgaaatatgacttcaaaaaagcctgagctgtagaattaattttttcaattgaatgagtaatactgctttaaaaaatatacatggccgggcgccgtggctcatgcctgtaatcccagcactttgggaggccgaggtagggagttcgagaccaacctgaccaacatgcagaaaccctgtctctacttaaaaaaatacaaaattagccaggtgtggtggcacatgcctgtaatcccagctactcaggaggctgaggcaggagaatcgcttgaagccgggaggtggaggttgtggtgagccgagattgcgccattgcactccagcctgggcaacaagagcaaaactctgtctcaaaaaaaaaaaaaaaaaaaaaaaaatatatatatatatatacacacacacacacacacacacacacacacacacacacacatacacacacacatcctttttatggcctcgtgcagtggctcacccctgtaatcccagcactttgggaggccatggtgggcggatcacctgaggtcaggagttcaagactagcctggccaacatggtgaaaccccatctctactaataatacaaaaatcggccaggcatggtaactggcctctgtaatcccatctacttgggaggctgaggcagggagaattgcttaaacctgggaggtggaggttgcagtgagcagagatcgtgcaactgcactccagcctgggcaacagagtgagactctctcaaaaaatatatataggccgtgtgctgtggctcacacctgtaatcccggcactatgggaggccaaggtgggtggatcacctgaggtcaggagttcgagaccagcctgaccaacatggtgaaacccgtctgtactaaaaatacaaaaattagccaggagtcccagctactctggaggctgaggcaggagaatggcttgagcctgggaggcagaggttgcagtgagccaagattgtgccattgcactccaacctgggtgacagagcaagactccgtctaaaaaaaaatctatctatctatctatatatatatatgtgtgtgtgtgtgtatacatgtatatatatacacacatcctttttagtttaaataatccattgtattagaaagaaaaagttacactagtgaatcagctctacagttttcagaaggtgaatcaaataattactaaattgaagtacagtaagatgaactatcatgtgaaattatatttccctataaatttcttatgaaatcttgcattgatttgtgcatgtgtgtttgactaatgaagtgaagtgtgggactactatagaatttagatttaatgcctaggtaatgggtacttgtccaattacaggtcttcatgaagtttctaatgaaaaaaacactaaagagctcttcttctcagctgtatcataaatgacaaaaatctcagctccccaggcctaagtcagtaataagtggaagagtgactcttctagttactaattcatttgtggagttttccaaagttagcttgcattgtaagtttcttataaggaggatcatttcatgagagttggttttttgctattgtcacaattgtgtaatcgtccccatagaagcatgatatgcatacacttaacacattcaatttgtaattcttcttgctagtaaagccaaaaattctatcccatgcttagacatccatggaggtgatcattataatgcattatttgtcaaattttattctttttcaaaactccaaagaaaatgtgacattctactatgtctttgaatctctgattatatacatttgtttatgttaatctataacatgttacttggtttctttgaagctctgttttctagttgatgatgctaaaatttatgttaattcacatctaggtgtacttgaaatcacctaatttgaaattgcagttcttaaacagctctaagaaatataattatgtaaagaatattttgaatgaaattttgaataaattggtagaaacatagttaattgttcgctgcatcccaaaacagtaggcttggaaagtgatgcttttctactttaattttaaatcttgtacattttataagaaaggagtaagcctatccccatattaggcaagtcagattaaatgttagttccattaattcagagaaaataagctcagttaatgatgattcaatgccagttgaaaaataaacagatatgcaaaatcttggtttcttcctgtaatttcttaccatttttttcagtttctttgttgttctgttaaatctttagttaggttatggtagaatgccgtggtacctcattgttctttaactctagtgattggttgtttttaattacattaatggtagttttttgttttttttgtttgttaattttttggtatatcaaacattttctgttaaaggagaaaggaaagaagagctttgacttacaaactgacttgaaagctattccagcaattggttgtctttgaagtaggcaatttaccctttttttcccttcaaaatcagttatactacatatttcctttttgaagcaggaaagaatgaactgtgcatcacagttctgttatctatagcaaatctgtaactcctgaatcctttcttcccgaccccacccaccctgggggctacttctctaccattagtttatggtcatcagagaattacaacaagtagagcagcacagccttgtgctttctactctaaaggtattgcttccccagacaactgaaacttgagttaagcccatgccccaggaaaagaaaggtcaggaagttattttgctttctggaaggctacagagatgagagcaaaggagatgaagagccttggcatctactccagaattgcttttgactgccagacttcgatctaatctctatggcacatcatcagcattcactgtgtacctcatacacaaaagcagaagagtagctggatttctttaaaattgtgcccttcatttgtttcccttgcatgttctatttccccaattaactttgtgagccctgggcaaattagttaacctcactgggcctcaaaggcctcatctataaaatgaatggtttagaatagatgatctttgatcccttccattgcaagcattctatgctgtgaaacctcaaggctgtaaactatatgagagtaggagccaatttttttttttatcattttttttatctccccacagggcctaatgtaactttgactgtactaccttgctttcactatgtgaagtagattttgaagacagctctaatatgtactaaactcgattagaaattagacatcccattttagttgaaagtcagcttattaggtagatgttatatgaacttgcttatttcaaaaggaaaaaaaattctgggaaatgaatcattgggatggaattaagtaatcccatttaggaaaatagtactttaataataggctatgaaagagttatgggttgaattgtcacccaaaaaggtatgtttaagtcctaatccccagtatctgtgaataggaccttgtttgtgattggaggctttgaaaatgtaatcaagttaagatatggtcatactggatgagggtgcaccctaaatccaatgactggtgtccttataagtaggccatgtgggacacaaagacacacagggagaatgccacgtaactgtggaagcatagactggagtgatgcgactgccaaggaatcccaaggattgatggctaccataaaaagctaggagagagaagtgcaacaaattctccatcagaaccttcaaaagaaccaaccctgccctgtaccttaacttcagaattcttgtgtccagagctgtgagagaatacatttctgttattgtaagtcacccagtctgtcataatttattatggcagacctaggaaactaatacagaagatgtggacactggcctaggaaaagtccccaaagaatacataaagctctggactggaacagtcatagcttgcaactaccgtaggacatctactttcagcctaggatgtcttcatattttataaaatataaatctagatagtaatagaacattaagatctttggagcaactcaccattccttacgagatcaggaccgatcttatacaaaccctgatcagctgaattaggatcacatttgttataattattaccgatcccttgagagccacctttgacccagcatatcatacccacaagcctaagagtaagctgcagaaagactgtttcttagaatggttgtccattattgactaccctcttctaccttatgcatgtttcttttgtccttttttcgttaaccatttataaagttagatgctaaagaatattgagctcagaaatagtatttccaaataaacaatgtgtaaatcaatttaagctgtttacttccccattgggaataatctctcttactttctacctatgaaaacttcacccaggctttcaccatgcatagctcagatcccatctacctcatcaaggcttcgttgaattccccatttgaaagtaatctgcttgctgtaattacataacttatactctctatgtagttctgttgacacttagcaaaaagtaccctatattatagttttgtttttacatctctgtgttttattgttaaagaaaaaattattctgacacttgttaaatatggtaaggctgacttcattcagagggactactacagtggaattttgtagtacggtagtgagattaagccaaactccacacacaagaagtaccaagtggacatttatagccatgaaccagggtgggggtcgattgatggaaaattactaagaggaaacatcaggcctaagggcattccagctaaactgacttgacaggattcttgctgaagtcagaccaagatgataagatatccagagtgaggaataaggaatttgatcagataatcaagggtgagggatctgcactaaactaacccagtagtatttttgctaaaacaggactaaatgagccagggacagagcctaagtttgggtctagttaaaaagggagctcagaagaatctgactcaagtttggtcaaaggagagagtctgtcattatctcctcaatgagattctagagaataggaattataattcatactcttttgtatctctactccctactgcccccacccccatgaaaaacagtgtatgcatgtcataaagtagtttgtaattgagtatttttcattgatggttgactaattttgacagagccgacaccttaattcaccagttaaattggctctaggcacagccttgcacaactcatcattatttgactaaatgaagacaatatattctaagactctggtacagaatttctggttaacagtggttggcataatttattctcttgcctgccattttcaagtgatgttactgctttgaactcattttttaaagtaatatttataaatataactggtaaaagtgtggcatctttggccaatgaaaagaattgctgtcagcttgagaaaagaaacgtaaagcactaagtatactagaaattgcagacatcctcacaaaagtgatggattaatgaccacatacagcattatgaaagctagttatggtttgcttaaaccagtctctctctttatggcattctcaatctttttaaacagctaggatataataacattttaaaaattaaagtatttcacataaccaagaacttgatatgaaatgagcaacattaagcacaaaacaattgaagcttcaaatactggagcaggcaagaattttaaacagcccgaatgaataaggatgcaacattgttgtgcttcttcagatgcaggaataatcaggctcagaggttagcagaaagagattttatagcaataatggctccccataccatttttctcttgtgactttgactcacaaaggtgaagctttcatttgaagatttgatacaatgcagctgccaacagcaggggggagaatttggccaaatggctggactctctcaaacatctgtgagggacagagattgagagggagagacagggagaaattgagagagatataaaaggaaaagaggaggggaccaaaaagaaaaaaaaaaaaaaagatttgcattaccaatgacaaatcaaagttgaaagtttgcctttcctgttgtcattcattgccattcatatttagaaagcagactgctgtgataattgatttgatggtccagcttgagtggaagcacttctgggcatagcagcctcagagatgccaaaaaagaagaaaaggtgggaatgaaataatgcactactttctcctcagaggcatgtggcccagtttttaagagcagaaaaacatgctctggggtggggggagtagaaacctaaagaacttagtaataaatacaaaaatgaccatatagctccagtcagataaaaataggcattcaaaccaagacaatgagaggacatattttactgacaagtgaataataggggagtgtggtggaaataatctgatttttaacagactctgtcctttgggagtaccttttttgctcttcttttatatagagacaaaagtgatttcttttctaaaaagccttttaatttttaagcttttcatactagattgatagttcagaaggagaaaaagaaaacaataattgagactgaaaagctatatatgtgcccggattatgtaaacatcactgaatttccttgaagcaataggtaataatgaagcttgtccttagatttgtgagtagaggttggtgttcagccattgcttcctgctgatatgaataagttaggaaactaaagtgccagttgaagggggcaaaagagagagagagagaaagagttttttaaagtactgaattcactgcctgacctcttaatcacaactgccaattggattgtatgccctgtcattccatttaagaacctaaacaaaccagataaaagacatagctgtcaaaacacaaattttaatcagaacctgtttgtcttttgagagaaatatacttgtgttcaaaagtagatcagtcctttaactttgttacctttctctcttttcttccctctcccttctatcttcagttctcctttcttcatttacgtacctagctagctgcctctacttatacctacagagaaagcctgttgtttggcctcattgaatgtgtcatacatatgcagctgttatgcaaatatcaataccgtcccatcacaatttctgttttcctggtaaggttctcaactacagtgagacattaaattttctgagttaaaacaacaacagcaacaaccaaaaccctcaaatgtatgacttatttttaaaagattcatccaaaattaatatggaggaaacagtgttagctgtcagtataatgtatgacagtatttctgaaaatcttttaaaaaaatcatgagaattacctgggaaacttactaaaattcattatacaatgtatacctatatcaaaacatcacgttgtaccccataaatatatatagttattatatatcaatcataaattgtttaaaaatttagagtatcagaccataccccaggtcttgaatcacagtatatagtgctcaggaatctacattttaacaagtgcccagatcatttttctacatactactgaagtttgaataccagagacataatagttaaagagcaatatttaattacatcaactggaatctaattccgtttttaccattactagttgtgtaaacttaggcaaattatctagcctttctaaaacttagtttcttcatccatgaaatgtatgtaacaatgcctacctaatagggttattctgagaattaaataacataacgaatataaaacacagcacagtagctggtgattctaatatcaatacatagtcaatattattgatattgtttatcttttatgatttagaaataggttcttttctatgggttgttcatattgcgcccttgtaaataatagtttctatttccattttatattaacatagacggtacttttccatgtctcaaggatgtataagattaaacatcaggccaggtgtggtggctcatgcctgtaatcccagcactttgggaggccgaggcgggcagatcacgatgtcaggagatcgagaccatcctggctaacacggtgaaaccccatctctactaaaaatacaaaaattagccaggcgtggtggcacgtgcctgtagtcccagctactcaggaggctgaggcaggagaatcacttgaacctgggaggcggaggttgcggtgagcgatatcacgccactgcactccagcctggtgacagagcgagaaaaaaaaaagaaaagaaaagattaaatatcatccccatcacttcatcttacccagtggggaaacaaactattttaaactaaagtagtagcacatgcttactggcatagagcagaacattcttattaataccaactctatgtaaataactagatatatacattattcacatctgaatgtgtaattaaagaccatttaggtactgaacttgatgaatgagagggaaaaatgtctgggatgtcaatgtgatactgtaaataccgaaggcaattcacagtgtgactagtagcaccacctgtctcacacccaaagataattcatcaaataataccacgtctaaactggcagattctttgtcttcatagcctaaaatagagaaaagatcactagattttttttttaaaaatctaatcccaaaacttaccagctctgttacttcagacaaacctcttaaccctcagtgcccccatctataaaataaggataattatatttgccccacctcacagccttgaagtgaaaagaaatgtggtaatgtatccaggaagcatttataaactaaatgctatacaaacaaatggtgttatttcatacctattcaaatggactgaaagtcatttgaaaatgttatcaacttttgaccgtgattgtattctcattttccaaggaagtccaaaagatagattaaatttgaattcttcattgttgtgccttgctgatttttgcttgaggtgatcacactgcattgatgcatttttacacagcttttgttgaatattccttggtccaaaagctttcagctttatggctttgaagctccaattccctgatcaatgtctgaacttgtgaagcttgaaatttgtcatttggcattgacttatgtgtaaatctgagtcaaaattcagtgtcctttaaacatctcggggcaaattttcagcatggcctcatttttactgatatgatcatgtatttgtaagtacagattgccacttttgtcctcaagagagcacaaagtggtcattgcacctgccatgaggtaattgaaggtgcaaaaaatcccacttctacaaaaaagtctttataacactcccttcctttacacccctcccttctgttcctctgtgtgtaccgaaaataaaaaaaaaaaaagaaataatgctattagcaggctatgaatagagatcagcatttcttttcaagaaaaataaactgcatttaatttgggcttctcttaaaaaaataagatacccggtgtaatttaaaataaaaatattgatggaaatggcaatgtctttcataattattattcaattgcaatgttatatactccataacttaagcaaatgagtagttttgactactggaaaatagcatttgaaagtcaattatggaacttccagcacacctatagttttagtgtcctaaacttatcctctaaagttactctagaccaaaagagtaacatttgtttttgatacacccttctttgtgccagtgttctctaagtactttttggattctcgtgctagagaaaaagagctataagaaatgaaagataaacctaacctagggttttatctgttaccagaacagtatatatgttacaaatgacttataaaattacccaggcagtgggagcacttcctagccatttcctggtgtgctacctgtggccattctaagcattgactaaaaattattcacagaccttgattttattgctagtgatatatttacacatactatttagcccagattattcatatactacatatatgcctactagcccagtgcaagtaggtagtcacttgtttacctctcagaaacagcaagctgttatttttcctttttaaaaatttggctatatttgttttttggttgtaggaagaaaacttaacaagagatctaccctcttatcaaatctttaagtgcacaatacaatattgttaactataggcactatgccatacaatagatctctagaatttattcatcttgcacaaatgaaactttatacctgttgaacagcaactccccactcctccttctccccagaccctggcaaccaccattctactctgtttctgtgagtttaactattttaaatagctcataaacgtggaatcccgcagtatgagtctttgtgtgcctgtcttacttcacttagcatatgtctccaggttcaaccatgttgtcacatatggcaggatttctttctgtgtttaaggctgaatcatattccattgtacgtacataccacattttctccatttactctattcattcactgatggacatttggattatttccctatcttggctgttgtgaataatgctgcagtgaacatgggagtgcagatatcaatttgagatcctgctgtcaattcttttttttgttttttttgttttgagacagagtctcgctctgtcacccatgctggagtgcagtggcgtgatctcggttcactgtaacctccacctcctgagttcaagcaattctcctgcctcagcctcctgagtagctgggattacaggcacgtgccaccacgcccggctcattttttgtatctttagtagagacggggtttcaccatgttagccaggatggtcttgatctcctgacctcgtgatccgcctgccttgacctcccaaagttttgggattacaggcatgagccaccgcgcccggcctcaattctttcggacatatccccagaagagggattactggatcttctggtaagtctgtttttaattttttgaggaagcttcatactcttttccataatggctgcatcattttacattcccactaacagttgtataagggttccaatttcttcacatccttaacagtgcttgttaccttttcacatccttaacaatgccttttacattttttttttgttgttaaatagtagacatcctaactggggtgaggtgacatctcattgtagtttttgatttgcatttccttgattagtgatgttgagcatcttttcacatacctgttggccatttgtatgtctactttggagaaatgtctattcaaaacctttccttattttttaaactggctatttgggagcttttttgttttttattttgttttgtttcattttgtttttgagatggcgtttcgcccttgttacccaagctggagtgcaatggcacaatcttggctcaccacaacctccacctcccgggttcaagcgattcttctgcctcagcctcccgagtagctgggattacaggcctgcaccaccatgcctagttaattttgtatttttattagagatggggtttctccatgttggtcaggctggtcttgaactcccaacctcaggtgatctgcctgcctcggcctcccaaagtgctgaaattacaggcatgagccaccatacccagctgttttgtttttttgatcttgagttatttgagttccttacgtatttgacacattttgcatagttagccctttatcagatatgcagctagcaaatattttctctcatttttgtaaattgccttttcattttgattgcttgctgtacagaagctttttagttttatgtaatctcactgtgtttttgcttttgctgcttatgcttttggtgtcatatccaagaaatcattgcccagaccaataccatgatgcttttcccctttgttttcttcaaggagttttgtaggtttaggtcttacgtttaaatctttaacccatttttagttgatttttatatataatgtgggatgaaggtccaatttcattcttttgcatgtccatatccaattttcccactaccatttgttgaagagactttccttttctcattctgtgttcttggcaccccatacaaagatcagttgaccatatatgcatggatatatttctaggctctctattctgtttccttggtctacatgtctgtttttatgtcagtcccatattttttaaattgctgaaggtttgtaatatattttaaaataaggaagtgtggcgaatccagctatgttcttctttctcaagatttctttggctattcatgctcttttgtagttatgaattttacgatgggtttttctatttctctgaaaaatgccattgggacatttaaagggattgcattgaatctatagattatcttaagtagtatggacattttaacaatattaagtctttcactgaatatcttttcatttatatatgttgtctttaatttgtttcatcaacgttatgtagttttcgccgtacaagtctttcacctccttggttaaatgtattcctaagtatttcattctttgtgatactatgcaaatgggattgctttctcagttttgttttcagtactttattgttaatgtacagaaatgcaattgatttttgtatgttgattttgtatcgtgcaactttgctgaattttttaattagttttaacagttttttgtggaatatttagggttttctctatgtaagatcacgtgtcggcaaacagagatagttttacttcttttttttttcctcccaattttaatgtcttttatttttctttttcttgtctagttgctccagctagagcttccagtactatcttgaatataaatggtgagggtgggcattctttccatttcctgatatgagaagaaaaactttgtgttttatcattagtttgatattagcagtgggcttttcatatatggccttaattgtgttgaggtaaattccttgtatgtctaatttattgatagtgtttatcatggaaaggtgttgaattttttcaaatgctttttctgcatctattgggatgattgtgtgatttttatccttcattctattaatgtggtgtagcacattaattgatttgcatatgttcaagccatcctcacatattagggataagtcccatttgatcatgatgtatgattttttagaacttagtgttgaattcggtttgctaatattttcttgggaattttcacatctgttttcatcgaagatactggtctgtagttttcttgtagtgtctgtgactttgtattagggtaatactggcttgattgaatgagtttcgaagtctactctcttaaagtctttaaaaagtgttggggttaattcttcattaaatatttgataaaattcaccactgacaccatctaatgctggatttttctttttgcagagggttttgattactgattcagtctccttgtttgttattggtctgtttagattttccatttcatcatgatttacccttggtaggttgtatatttctgtgaatataaccattgcttcgagattatccaatttgttggtgtataattcttcatagtagtctcttctgatcctgtttatttctgtggcatcagttctaatgtctcatctttcatttctgattttgaatcttttttttttttttagtataaggatttttccattttgtttatattttcagaaaaaaacaattttctgtttcactgattttttttctactgcttttctgttctctatttcatttattttgactctagtctttgttatttccttgcttctgctaatgttgggcttctcctaaatttgttctttttctggctccttgaggtataacattagattgtttatttgagatctttctacttttttaatgtaggcattttatcaccataaatatccctcttagaattgcttttgctctatctcgtaagttttgttatgttgtattttcatttttgcatgtcttaagatattttctaattttttttttaatttcttcattggcccattggtttttaaagagtgtgttgtttcatttccacatatttgtaaattatccaattttccttctgctattaatttctagtttcattccactatagtcagaaaagatactgtgtaggatttcagtcttaaattcgttgagactttttttgtgacttaacacgtgatatattctggagaatgttccatgtgtgcatgagaagaatgtgtatttcacaactgttggttgaaatgtcttctgtatgtcttttagttcctcttgctcttagtgttgttcaagtctattgtttccttattgatttttttttttgcctggatgttctattcattatcaaaagtgggatatgaattatcttaccaataccatagtgctgtctgtttcctacttcagatctgtcagtgtttactttgtatatttagatgctctaatatttggtgtatatatggatttataattgttatatcttcctgatgaattgctttcattattatgtaatgacctttttcgcctctatgtcggtttttgacttatagtctattttgtgtcacataaagtatagccactcctgctctcttttggttaccatttgtgtggaatatctttttctgtctctttactttcaggctatgtgtgtcctcaaagctaagtgttgtctcttataggtagcatataattagatattgtttatttatctattctgccactctgtgtcttttgtttggggagtttaatccatttgcatttatttatttattttattttttttgagacagagtcttgttctgttgcccaggctggagtgcagtggtgcgatctcggctcatggcagcctccgcctcctgggttcaagtgattctcctgtctcagcctcccaagtagctgggactacaggcgtgcaccaccacacccggctaatttttgtatttttagtacagacagggtttcaccatgttgcccaggatggtctcgatctcctgacctcatgatccacccaaagtgctgggattacaggcgtgagccaccgcaccaggcctccatttacatttcaagtaattattgatagggaaggacttactattgcccttttgttgattgttttctgtttcatagtctttttgtccctgttttcctctcttgctatcttcttttgtgatttgttgattttttgtagtgatatgctttggttccttcttctatttcttttgtgtatcttctatagttaatttctttatgattaccatgaagcttgcatagattgtcttacagttacagcagttctatattaagctgctgacaacttaactgcactcacatacaaaaaccttccacttttacttctccctcaccatactctgttattgatgtcatagtttaaatctttttatattgtgtatccattaacaaatttgtgtagttataatcttaatatttttgtcttttaactttaatagtagagtttaaagttatttacagtccaccattattgtagtatccgggctgggcacagtggcttctaatcccagcacttcaggaggccaaagtgggcaaattcattgagtctaggaattcaagaccagcctgggcaacatggcaaaaccctgtctctattaaaaatgcaaaaaattagccaggcatggtggtgcacaattatattcccagcttctcaggaagctgaggtgggagaatcagccgaggctgcagtgagctgtgatcatgccactgcagtctagcctaggcaataggaatgagaccctgtctcaaaaaaaattatctatgtctatatctatattatatatatatagtattctgtgtttgtctgtatgcttgcccataccagtgtgttgtattctttcatatgcttttgtgttactgttttagcatctgttcatttctactggaagaactcccgttagcatcatgtctagtggtgatgaactcccgtgccttttgtttggaaaagtctttatctcaccttcacttttgaaggacaattttgccagatatagtattcttgattggcatttttttttctttcaacactttgaatattataagctcactgccttctggtctgcaaggtttctgctaagaaatccactgatagtcttattgaggactcactttacatcacgagtcacttttctcttgctcctttaaaatttttctttgactttgtgcaatttgattatattgtatctcagtgtagacttctttgggtttgtctaatttggcattctttgggcttcatgaatctggatatccatttccttgcccagatttgaaatgttttcctccatgagttctttatataagctttttcccctgactatctctcttctcctttgagattcccataatgaatgtattggtctgcttgatgatgttcagtaagtagcttaggctttcttcattctttatcattctttgctttttgctcctctggctacataatttggatgacttgtcttcagtttcactgattccttctgcttaatcaagtctgctgtttaatcactgtagtgatttttcagttcagtcactgaaccagaatttctgtttggttatttttatttatttatttatttatttattcatttatttattcatttatttattgagacggagtttcactcttgttgcccaggctggagtgcaatggcacaatctcggctcactgcaacctctgcctcccgggttcaagctattctcctgcctcagcctcctgagtagctgggattacaggcatgcgccaccatgcctggctaattttttatttttagtagagacggggtttctccatgttagtcaggctggtctcaaactcccaacctcaggtgatctgcctgcctcagcctcccaaactgctgggattacaggcgtgagccaccgcacccggcctggttatttttttttaaataatttctacctctgttagggccagatgtggtggctcatgtctgtaatccagcactttgggaggccaaggcaggtggatcacttgaggtcaggagatcgagaccagcctggccaacgtgatgagacaccatctctactaaaaaaaaaaattacaaaaattagccagttgtggttgcacatacctgtaatcccagctactggggaggctgaggcaggagaatctcttgagcctgggaggcaaaggttgcaatgagcccgagattgtgccactgcactctagtctgggtgacagagtgggactccatctcaaaaaaaaagaaaaaggcaactcaaacaacaacaaaaaaaccagcctgagctgggcatggtggctcacacctgtaatcccagcactttgggagtctgagatgcgtgaatcacttgaggtcaggagtttgagaccagcctggccaacatagggaaaccccatctctacttgaaaaacatatttatatatatgtatgtatatatttgtgtgtatatatatatatttatatatatgtatatatttgtgtgtgtgtatatatgtatacacacacacacacagaaaaattagccgggcatggtgtcccatgtctgtagtcccagctactcgggatgctgaggcaggagaatctctttaaccagggaggcggaggttgcagtgagctgagattgtgctgctgcacttcagcctgggcaacagagcgagactctgtctcaataaataaataaatacatacataatttctacctctgttgacattctcattttgttgctgaattattttcttaatgttgttcagttgtctatattctcttgtaactcactgagcttccttaagatgattattttgaaatctttgttagcctattcatagatctccatttctttagagttgtgtattacgatttaatttgttcctttagtgtaatgtttcactgatttttcttgtttcttatacttttgcactggtgtctgcacatttgaggaagcagccacccttcccattctttctggacttgtttagacatggaaagagcttaaccaattcactaggctagagattctaggagcctctcaaaccttttctatgaatgtgtcttctctggatttgtgtgggaggattcctaattagatggatttacccctagcacaattcatagagccatgctaatgtcttctgaggcaggacagaatccagcccgaccctggtggttcactgaggccagattgttgggaacatgttccatttctctcctatcacagtggaagaagcatcaggctctgtgccttctctcaatcttgtagagctatgctcaccacagtaagctgcctgccctttttcctttgttcttaattgccctgaaacatccaagctatttcttttctatcagtgtcccatgtgaggtgagatagaaactagcccttcaggcagtgcaccaaaaggctggtacattggaagcattctctactctgtattttcccctgagaaagaaactgtgggccaaagtgatatttttcagtgctgagctgtgatggcttgggggaaggggctaatactagtaaagtgaaattgctccttactcatttcagtagagttttttcagttttgtgtttctctggtgtactgcaacctcttaaaaggattctggtcttctcataaaggtattgtggtctacattgttaagttggtgtttctatgggagaacaagagatggaactttctatttcaccattttgatgatatcagcaagctattatttaaatgagaagtttcctttacttagatgagcaatataatttaatgcaagtttgtctatggatttctccttgagtgactacattacaaaaggccatctggaattccctttctacacatcactgttaaagcaaaaaactatatttaagtggtaccaaggtatcaggattccctgcagacagtttgagatctaatataaaatcaaaaaccccttataggccactggtctaaatgatgacagtaaaaaattcccaagactattaagttttattaatgaatatgatggaaaataagatcttggaatgtgaattaaatgtttttaaggtgatgagtgggtaagaaagagaggtgataaaagtttttgaaaacttgttttcaaagcaatactattacatattaaatatacagtttaaacttttctcatcctgctgacaaatacatacctgagccaagattactgttttgtttcattttaaccattcccctacatggtaatatctatagtgaatgaccatttctggagagttttactttgatatgttagcacatcattacctgttaggtagccccaaaatgtaaataaattatacctcattccatattgtcaaaacatagaaacagcaacaaagatacctaaatgaaagaagctgtgattgtttttcaaaaccaaagaagagaagtgtaagaaaagcattgaatttaaggggcagaaactatcccagaaagttactgctagaattcaaatactaaagaaagtaatagaattatacctttataaagatcaagggtaacaaatttgaattggtaccttttttttttttttttttttttttgagaaggagtttcgctctcgttgcccaggctggagtgcaatggcgcgatcttggctcaccacaacctccatctcccgggctcaagagattctcctccctcagccttctgagtagctgggattacaggcatgtgccaccacgcccagctaattttgtatttttagtagagacagggtttctccatgttagtcaggctggtctcaaactcctgacctcaggtgatccacccacctcggcctcccaaagtgctgggattacaggcgtgagccaccacgcccagcaagtaccattttcattcttaaatttgttcatatgttaaaaaaaaagaaaacataagcatgctttagttttccatcttcacattaggtaacacaatgaatgaatgaatatagttattttctaatactctcacacagattggttcttccatgggtaaatagttctctgtagccctgaattagattttttttttttttttttttccgagacggagttttgctcttgtcaccaaggggggagtgccatagcactcaccatgtctcaccatgttggccaggctagtctcgaactcctgacctcaggtgatccgcccacatcggcctcccaaagtgctgggattataggcatgagccactgcacccagccatgaattagattttgattgatgaaaagggagataataattccaataatcttatgttccataaatgaaattttaaaactgatacatttttatatttaaaaacttcaaaataaatagaaaaatacaactttgagttgtagttttttttagtggtcaatctgatgagcttgggcccgtataaggtatgttggacaagaaaacactatcctaatcaatgttgacttaactgaattcattcagataagtggaaatattgttagatttgttgactggaaggaagtctgagtttgattagtccaaaggtgatttgaggaaaggtggtaagctgaacatgacctcccctgagtattactgaaaggaaggagaatttgaaccaaattttaagatttggccaggaccaaataagatatcattgcagaaaatctgtgctatatgtcaatgacccttcagaaaataaaaagtaaagataaaatggagttggcactccatctctggcctgtgtgtgctgcccccacccccacgcctcccttctgtctctcaagttttgagatcacccctgttaacctcctcttctcttccctggctcagccaatttgtaagctctgatcacatttttttttttttttaccacattctctttgtaccctatcttttgctttcttatagttgcttaatattgtgtaacggaggccaggcacagtggctcatgtctgtaatcccagcactttaggaggccgagtttggcggattacttgaggttaggagttacagaccagcctggccaacatgatgaaaccccatctctactaagaatacaaaaattagcgaggtatattggcacatggctttaatcccagctacttgggaggctgcagcaggagaattgcttgaacccgggagttggaggttgcagtgagccaatatcatgccactggtatattggaagcattctctactctgtcttttcccctaagaaagaaattgcgggccaaagtgtgtaagggaagggttaaaatgagtgagtgagtctctctctctatatgtatatatatatcatataacagtctttttctaattccaaggaatagaggcatgctaaagtttttaaaggtaatatagggttaagaaaatatgaggaagaaatatcacagtggtctcccagccatggctcatcaaaactagaatgttctgactacaacagtggctctggaagtctgacagcacctctgacatattgaccaccctgctggtagtcttcctttaggagcaggtttgtgcttgattccagttgtaacttactaatccttctattcttatgatttgccattatggtgtctcagctactgcatttttatttttctgtctatctaattcttcttttatttccttaacaatgaatgaactctctgttctcctttctatatcagggtatctgcttatttatggtttctactgccatgtggcttttaacatcctctctctcttagcttctgcttctgcctaacatacatatccgtttctgcatgtgtctcattaagttaccccaagaaaaatttggtttgtttggttcagagcagagattttctgctggaaaaatctctcatggcaatctatagatagttttctttggtacgtactcattatctaatctcttatgattggggtcatacgaaaccaaacattgtgacctatatgtaaagtacctctttagcaggagactctaaggtatctcagaagagagtagtacaacagagatattatttacagaatattctgtatattgagcccttacatcaggagacttgaggtactagatgtttacttttactatatatcattgaatcaaagatagtatcaatcataagatattacattaatttatttaccattgagaaaggaaaagatgctgccaatgaaatcacagcacaccaatgattgttagatgcatctcagtctcagagatgttaaaatgtgaaaaaagtacatttttaaaagatgtaatgtggtgtcagtagcatatctgagattgtctgaggatcaaagcaggtatagtgaacccccagagaagttccctgaggactgactcctagagtggggtaaatgctaaaggttacaggttggattactaatctgacagaccagagggtagtgtctagagactagatagccagctatctgtctgcaagtggagaggaggccagtcactggtccagagtgtggtttgcctcagggacttggcagatatcagaaggtagatccaaggagaaggtgaattattcctgtattgatttaaatgacatgaatatattgggaatttctgtttctcttaattcctcatttgtgttctgggatcaattcagttgtgtctcttatcttctagaatatctccttgtttattacttgtacattaactatatctctggatgtagggtcattttataaaccaaatgctgtattttgtccatgaggcacctaaaatagcacagccagggatagctaagcttacagttgtgatacattaatgaataacctctggttgttgactccctttttgttattgggagagttaatgtagcttttttcaaatttttagattcagcgggtacatgtgcaggtttgttgcataggtatattgaatggtgagatttgggcttctagtgtacttgtcactcaaatagtgaccattgtacttaatagatttggagatttctcagagaactaaaaatagacctaccattcagccctgcagtcccactattgggcatctacccaaagggaaagaaatcattctatgaaaaagacacctgtactcatatgtttattgcagtactactcacaatagcaaagtcatggaatcaacctaaatatccatcaacagttgattggataaagaaaatatggtatatgtacaccatggaatactatgcagccataaaaaagataactttaattataattatgaatcaacatgtctttctttccatttctactatgtaaatagagcagaaatcccacattaatgtgattagcatagaagaaagtcctcactgaattccccttgctctcttaccaactggctggacatggcataggtggttatctaagaatactcccatgaatcttcacagcattcagagatcagtttactctgggtttgttagatatgcgatatgggctagctgtttgttagaaccacatttcccaatgtgtttccactgaacacttattttttctgatgttgctacatgtcttgtgtaaaaagcattgggtaaaagtgctgggtaagttaaagggctctgataactctatataatgtatgtagatttctggctgaatctttgggtgtttactgctcatgggttccactgctattacagcccaacacagctggtatgatttgcaggttggtctcttggggccctttcaccttctgagctctgaaagcctaagataagcaatttttcctttgtccttcaagatgactgtggtctcagcttagactcaagagaactcgtttgaaattgaacaagagcaagcctagctcaagaggatagcaaagtgcctagttttatttgtcactgcactagaaacttcctaaggaataatttttaaaagggggccagttttgtttctgagactcaactagactttcactcatgctctgggggaaggaattcaagtctccaacattgtccttattgtacacctgtagggccagactgattatcctaaattttacatagcctaagaatgagcttagatttcaaaataaaaagctttctctgcttttgcgtagaacatttctatctattatttcagttaatttatccttgttatcaatattgaagtaccgcttgctatacatattctagacatgggtaacaatgtctagaagtacactctgatttcacaacagccattcaaggagatatatatatatatatatatatatatatatatatatatatccttgcaagtgcattctagggctgctgggacatgtgttcttaaatcctcctttgccagttctccaaatatgccaaattgttttgaaatggcattcttgtcttgtcttgttgaatctacacttctattccttccttttgctttttattccaaccttccattttctatcctttaattaaaaagatggctaatatatgggagatgttgtagtccgttgttgtctaaaatgaatttagcagacactcccccaccattccccctccccaagttcagcatcaggaataaaagtctcatcagtccttttggcagcatttaagtgaatggcccccagtggctttatgcttgctaatttgagtactctttttacgtacagagctagtcagattgacagaccacactgtacgaagatatatactagtctttgagtcatagattttgtaaataaactgagaacagtggctgaaaatcagattacctgaaagtctggaaggaaaaaggcatagaatgacctcatctagtctcttttcaaaagcactatatatatttcaaattttagagtttctagagacaattagcaggcagtagttgcaagaataggcagaacccctgtgagatgtataagctgtatgatcttcattaacttatatctaaaagtttaacaaacatatactgacattatttttaaaagacaagtatgttaaggaatttgtcttctacatagtgacaggtatcaaagtgaagaatatggccttttgtttttttcttactatatactaaaatgttgctttatattaaaagatcgtaatttatttccatgaatcaaattctgtacttaaaactgacttctgtttatttatatactgttgtgtgatagaaattctcttgggggaggcaatagaaatattacatgccttttaataaagcgggcttttaaaataatttaattcaacttttcacctcttatgaaatttttgaaaagatattttctaatttattttattttattattttttatttttgagacagagtctcactctgttgcccaggctggagtgcagcatcgtgatctcggctcactgcaacttccgcctcctgggttcaagcaattctcctgcctcagcctcccgagtagctgggattactggcatccaccaccaagcccaactaatttttgtctctttagtagagacagggtttcgccatgttggccaggctggtcccaaactcctgacctcaggtgatccacccaccttggcctcccaaagtgctgggattacaagcgtgagccatcgtgtccagccttatttttttttattttaaatagagctctccaaataatgtctgttttgtattgaaatgaatgaattcatgaacttgctttcttcgcagcatgagggactaacagctagaataaaaataatcaacctaatatttcttgttgctggaaaataattatgagaatattacacagaggaagccatgcttaaaataaaggcttcatattgcatttaaaactcaggcgggactttcaaggattctgtttagtagaataatatattgatgaacccttggagaaccaattatgttgtttcacatgaattacaaatgcatcatttagctgtattatagtcttacatgtgtcctttacaattaatcaccattaaatgttagaaatgtaaaatttaagaggcaaagaaagcatacttctttaacaaagtggcccaaacaaataccagtattttaatttgaggtctgtaacaggtctacagattttattttctcattttgcaagatcagtgtatgaatctgagttcttttaatagatttttcttgcaaaatcttattgttaattgcaaatgtaagttgtgacagtaatttttagtataccactttagacttacttctggaatttgagcaacagaaacatattattagaactttttattatttctgtagctatcttttcaaatatttccaaaacgtatggctttttaagcctttgcctctgcaagtcacaatttcaagtaggcgctgaaattctagtaacgtgagcagtgcaacagtacattgagtcttaccagtaagttttagtgaattatttaggaagtgaacgttgattcccttatgagtcagtccagcctctttctgaaaatagtgttgttcccattatgtgtaccattttgcaggaaaatattgtattccaaggaactgggtgttatcagtaattaagtaggcagaacccatagatattgaatagtttaagttgtaaatgtgataaacttctataatacaaatatttgtggacagaaaatgctgtgagatatggaagcacaaagtagaagtagcatttatgaactgttactaagttccagacattttactaagtgctgaggatactgagataaataagaaataatccctttcctcgggaaattataccagtggtagaaatactccaaagggccaacagtgaaggaatcacaatgaattgacatattatgtactaaatagatctgctcacatcctgaggtctccaggcaaggtttacatgcacttgaactgccctgcataattgctattctgctgacaaaagtataggtgtggtatggtagagctcaaaggactctgagaagtcatatagtccaaatccttcattttccagaagaggagaaccaggcccagagagggtgaagggattttctccaggtcatgtagcaaactaacgacagttgggactataatgcagatttcttgatcctcagtccaatctttcaagtggagataacctcaaacctttttgtttccccattctctactttaagcaatggcacaagaagtccatgggaaaatgaaattccctaaatggggaaaagaggaccttgatagaacgctcatgagatcaataaagaaattaaaggacagggtgaaaaaatgtttaaaagtatgtagggagcacatatagaccagaaagaaaattaagaaaatcccagtggcaaaaataagagaattgcaaagaaagggctgaaataattatccaaaaacaattctttttatgggtaaacaggctaaaatgccataggtctaattttatgcattcaacctgcttcagaattttttttcaaactaaatagtcagctatgttaagtagcctcacattaaatggaagaactctctattatttagcacatttgtatagttgcaacgtagtgatgagtgatgtgtctaatgatggccccaagacagtgtaatgccccaatgtaccttttgagctattgaaaaatatttctattatgttcagcctagttttatttttaactatatttaatattcaaaatcttggaaatgggagctatgtttataatatctctggcaattatctataaatacatctaagttgatcgcagcacttcatatcttagataggctgtatagtagagactttactgtaacgagaaagatcctgaattgttaccctacttgtcttcccagatgttttctttgttaggctttttgggatttctgatttttcttgctctttttcttataaaatgtgaaatatatagcctgtgataatgcttggctgccctgcccaattattgaccaatgtcgatccaattatgcttttaaaagtatatattatgtaaatagattattttaccttctgctgccttataaatctttttttgtacagcagcaagggaagattataatgtcattggctgtcaaaatgcccttttcatgtaagtcagctgccaggcaaggatcctacatctgttttctagcatccatataaatgtctgtgataaataagtcattgctcactggagctgcctttgtgaagcagatcctgtacttactgtttctttcacatgcaaaatgacagcagtcaacctaattgactattacttggtcagtttctgtgtcagaagtgatgccaggtaagtaggagaaatccaaacttaatgcatttctgtttaaacccagaaagatttagtaatagaaaaaacagcaccaatttcaggtttttcagagatgagtgtgttcccaaaggatgaacttgacactactgcattctttctcacaacctaaactggattcttctatgaatctctgagtgaattcttagtagacacattgacatggtataaaatacatcacacggctgtaataaacataggttagaattgtggttcagttttcagccaaatgccaggataccattttcatatgtagtctttcctaattggaaatctagaggatggggtacaaaatagtcatcctaatctgttcaaacatcaatggacaattatgtctctaaaattctcaatactttgcaattaaagagtttttgattcctacattgcagagcaggcctcttcttctgtgactgatgctgccctctcttttctatgtcatctctgctttggaatcatcatcattacggggcatgataccagtcatgttaggccatgctgctgacaatggttactttcaacaagggggagtaaccagggaaaggacatccatcattatgtaatgtaggggaaaaaacccaaagactcagaagccatgttaacaaacacagctggaagcaaggaggcatttgagtaggattacaaacatcttagattgtgcagattagtactagatttagggaaaacatgaattgaacaacctcttttgcacaaatgagcaacctggagtttgcagtaatggagccaatagcctcatcacattttgaatccatttggatgtcatgtaaagaatgaacatatgcagtacttaataaagaaaggtcaattctgccatggtgatcactgaagcataatgcagcaaatgaggtagggcttttttttttttttaactcatcaatcctagaacatttaaatttatcttttcagtaagttgagggatttttttaaatctcctgcatctgttataacctaaatgaacagcagttcaaagccaactccacacctgtactgacatactaaaaatgtcaaataatttgtataaaaatgctgagatgcagtttcactaacagtctgttttgtcagtgtcctccctatttatcagattctaagaggattgttgggttgatgtggctctgtatatttccaattccctcctatttttggattgtactgctttgattatagttaacaaccaaccttgcaagaattcaagatttgtcatagctacaatactttttccacctcatagctttaacagtggcatttgtatgttacccaaaccaaaccactgagttcatcattttcatccaaagaagagtagcttccttgattttcagcataatgtttctggctatctagtgcctttttttttttttttttttttttttttttgagatggagtctcattctgtcgcccaggctggagtgcaatggcgccatcttggctcactgcaacctctgcctcccaggttcaagcaattctcctgtctcagcctccagggtagctgagactacaggcgcacgccatgaagcccggctaatttttgcattttttagtagagatggggtttcaccatattggtcaggctggtctggaactcctgacctcaggtgatccgcccaccttggcccccgaaagtgctgggattagaggcgtcagccaccatgcccagcccttttttttttttttttttttcagatggtaaactaaaaggaaataaaattgtaacctcagctggtgccataattctttcttggcttatagtttctgaaaggtgttgaaacgattacatatttatccatgagttccaaaattgcccctctaattcaagtcattagaaccttcttccacctacaactcatttgaactgtttttcattaaaagtcatgtccaagagtcagttcgagtgtcacgttatttggtcattccagctttcctcctgagtcttgtaaccctgactatcattagtgctgtatatagttctgtccacttgtctccttttcttatccagtagttcttggagggcatcaactatgctatctttgttgttttcacattgcttatacattgtggagattgaatacatttttgatttttaacaaacgttcaatgtgctcttactaaagcttggcaatgacctagatcaggggtttgccaactatggtcagtgggccaaatccagcccatggactagagctaaaatgttgtttatatctttaaagagttgtaaaaacaaagaagaatatacagcagacaccatatgtggcccacaaaggctaaaatatttgccatctggcccttcacaaggaaaatgttgctggcctttcttccagatgctgaggatacaccagtgaacaaaaccgacaaaaaaaaaaaaaaaaaaaaaaaaatccctaccttcagagagcataaattctatttttttacaacaattttatgcagaatacgcatcttatttttgtaaatatgcacaatatttacatatagtacatactcaatatttgtgaaatgaatgaataagtcatagagtccatcatccaatattatataatattggcaaatatttccatatgatgtaataaaatgttgcattttttaaatctttatatgaagaatttttccctagataatttttagaccaaaaactcaaacactacttacttgtcaagacattttattctggtacttagtaatgatttcccatcttaatgtaacttttattcatgatgaggtcctgattatctagcctccttatgagaggtaatcataattatatttgattctgaaagctttctgaaatggtgattctttcataagagatcattttgtatacgtgacagttaaaacaatgagttagtttttcagagtttctatccttgaattctacaagtttgtgatgtttatagcttgaattcagataaaaccattttgctccacatttgaaacgacaaatcttttgcattagactcagagttgactaaaactatggcagcttttcataaagtcaggctatagatgtccctaattcccccacagagcccacagccctttgaaagtgatgatagaatactggggatggatcagagagtgctgagaggagagtggaagggaagaagggacaaagggaaaggaatccagagtgggaagagttggattcgtagagccagcagatggtgttggtgataaagaagattacgtgactcatttctgtaacccatgagtgtcaaagttctccactcagtgccatgtctccatcccattacccccacctaaataagttatctgttctaacacccatctgtccccacaccaaaccatcattaccagcaagcaatttcttgtactgtcctttatcttttaaatattaaaaattagaagtaaatgagatgtgagatctaaaaaaaaaatgacatgaccttttatttatttccactggtcttttaatctaggctgcccttactcctcatagactatacactgcctcttagatactacactgctattagtctaaatactttgctttattatggaactgctcatttcttattccttgcatagatttagggttgataaactgagagtttaaaatgcagtaatggagaatcttaattataaatgaaggaaattgaaacatactactgtatgtgctgatttactttcagattcttgacctttgtcaagactaatgagattacacatctagtatagagaatggatagaaattttaatagacctgcctaatttacattgttaggaattctgtaaaactgagagttatgccagcaaacctacatgtgctgtctttttaattgcatttctccccaccaccagcccaccctcattccctaatatctgtggttagtacctatggagtcattacttacattatgaagtgacaaacataggaaagcatggctttgttctctgaatgcagataactcatatccatcaaagtttctaatttacagagctttcctttgaaggaggctagaatgctgagtaatgatgaaaaagcaacatttgttaaatctgatttggcgcaggacttctttttctacaaagcagtctttcataataccagcttgaatctaactatttctcttacgtagtatagggggaaagaaatatcttttcttcccatcttagattcatagctaggaccccttaacaacaacaataacaacaacaacaaaaaaaaaacagattacccgactaccaagagaaaagcatacaaagttatttatttatttatttatttatttatttatttatttatttattattttttgagatggagtctcgctctgtcgccgaggctggagtgcagtggtgcgatcttggctcactgcaacctccgcctcccaggttcaagcaattctcctgcctcagcctcctgagtagctgggattacagatgtgcaccaccatgcctggctaatttttgtatttttagtagagatggagtttcaccgtgttgacgaggctggtgttgaactcctgacctcaggtgatccacccaccttggcctcccaaagtgctgggattacaggcgtaagccactgtgcccagcccaaatttatttaatatacgtaaattttatgtgacacaggaaatttaattaggaaataaagacccaaagaaacaggaaaacctgtgtgttcttttttttttttttttaaattggcattcatgttgctttttttttttttttttttttttttttactattaggaacttttattattattatactttaagttttagggtacatgtgcacattgtgcaggttagttacatatgtatacatgtgccatgctggtgtgctgcacccattaactcgtcatttagcattaggtgtatctcctaatgctatccctccccactccccccaccccacaacagtccccagagtgtgatgttccccttcctgtgtccatgtgttctcgttgttcaattcccatctatgagtgagaacatgtggtgtttggttttttgtccttacgatagtttactgagaatgattatttccaatttcatccatgtccctaaaaaggacatgaactcatcattttttatggctgcatagtattccatggtgtatatgtgccacattttcttaatccagtctatcattgttagacatttgggttggttccaagtctttgctattgtgaatagtgccgcaataaacatacgtgtgcatgtgtctttatagcagcatgatttatagtcctttgggtatatacccagtaatgggttggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcattttttcatgtgtcttttggctgcataaatgtcttcttttgagaagtgtctgttcatatcctttgcccactttttgatggtgttgtttgtttttttcttgtaaatttgtttgagttcattgtagattctggatattagccctttgtcagatgagtagattgcgaaaattttctcccattctgtaggttgcctgttcactctgaaggtggtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtttaaggtgtaaggaagggatgcagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagtttgaagtcaggtagcgtgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggaagtatggccattttcacggtattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactgctgaagttgtttatcagcttgaggagattttgtgctgagacaatggggttttctagatatacaatcatgtcatctgcaaacagggacaacttgacttcctcttttcctaattgaataccctttatttccttctcctgcctaattgccctggccagaacttccaagactatgttgaataggagtggtgagagagggcatccctgtcttgtgccagttttcaaagggaatgcttccagtttttgcccatttagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggattttggtctaaaattctcttttttggttgtgtctctgccaggctttggtatcaggacgatgctggcctcataaaatcagttagggaggattccctctttttctattgattggaatagtttcagaaggaatggtaccagttcctccttgtacctctggtagaattcggctgtgaatccatctggtcctggactctttttggttggtaagctattgattattgccacaatttcagagactcttattggtctactcagagattcaacttcttcctggtttagtcttgggagggtgtatatgtcaaggaatttatccatttcttcaagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagtggtctatcaattttgttgatccttttaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtatggtttctgccgagagatccgctgttagtctgatgggcttccctttgagggtaacccgacctttctctctggctgcccttaacattttttccttcatttcaactttggtgaatctgacaattatgtgtcttggagttgctcttctctaggagaatctttgtggcgttctctgtatttcctgaatctgaacgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggtttttctagttatacattcttctaaatttttttcaaagttttcaacttctttgcctttggtttgaatatcctcccgtagctcagagtaatttgatcgtctgaagccttcttctctcagcttgtcaaagtcattctccgtccagctttgttccgttgctggtgaggagctgcgttcctttggaggaggagaggcgctctgatttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgtggtgtcagtgtgcccctgctggagggtgcctcccagttaggctgctcgggggtcagaggtcagggacccacttgaggaggcagcctgcccgttctcagatctccagctgcatgttgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgctgccttgcagtttgatctcagactgctgtgctagcaatcagcgagattccgtgggcgtaggaccctccgagccaggtgcgggatataatctcgtggtgcaccgttttttaagcccgtcggaaaagcgcagtattcgggtgggagtgatccgattttccaggtgccgtccgtcacccctttctttgaccaggaaagggaactccctgaccccttgcgcttcctgagtgaggcaatgcctcgccctgcttcggcttgcgcacggtgcgcgcacccactgtcctgcgcccactgtctggcactccctagtgagatgaacccggtacctcagatggaaatgcagaaatcacctgtcttctgcgtcgctcacgctgggagctgtagaccagagctgttcctattcagccatcttggctcaggaacccaaacctgtgtattcttatgcttaggtttgatgaagaagtggagggtagtggagaaatatgactggacaaaggggatatgatctaataataataaagtgtgggggacttaacaaggcctgtgttttctgattcttttctgtgtccttgtatcttcagagataaggatgttcctttcctctgaatgtggggtttgggggtacctctggaatgaaggttttatggcctgcttcaagagagaagggcaaggggaaggtgagagtgaccttgcttctgctattttatcaaatgccaaggtgacatactgttggtagcgggtcttgaaccccatcagtagcaaaacaagggacttctcactctgaaaagctggtagattagtgaattctacatctgaaggattatactcataataataaacatataaaataagccataaggccgggcaccgtggctcatgcctgtaatcctagcacaccgggaggcggaggcgggcggatcatgaggtcaggagttcgagatcagcctggccagtatggtgaaaccccatctctactaaaaatacaaaaattagctgggtgtggtggcacacgcctactgtagtcccagctactcaagaggctgaggcaggagaatcgctggaacccggaaggtggaggttgcagtgagccgagatcgcgccactgcattccagcctcagcgacagagcgagacaccatctcaaaaaaaataataaataaaaaaaaagccataaggccatgaatgtactccatcaataggtatttactgaagaaatactatgtgcttagtactgtgggaaatataaatgtagaaagcttgctctgtttacttgggtaatcaagacttataaaaaataaaagaattatatgcaaaaacaaatatgtaccaaaatgatgttctataggtttcatatatcctagaattttcaaaataatcaaaattcattatcacatcacatgtttacatttttagtgcaaaaaataggctctgtggcaataggacctcagagaaggacaagatcactatagtttgtgatactccaaaaagtcttcacagaggaggcaacgcagcttgtttatcctacagatattgtgtcatctcttttcagataattgtctgattatacctgtggctatttccccctgaatttcttactagttggtttttggttttgtttctgtttttcaggataaggtcttgctctgttgtccaggctggagggcagtggtgcagtcatggttcactgcaaccttggctcaagtgatcctcctgcctcagcctcctgagtagctgggactacaggcatgcgccactgtatctggcctgtttttttcttttatcttcttttttactcattcataataatgcagaattagaagcaatcccatgtctttgttttatctttatcgaggtataattggcaaattatgtatattcaaggtgtacagcatgatatttttatatgcatatacattgtggaatgatttctacaatcaagctaattaacctgtcacctcacatagtgatggagtccatagtgatggacctcacaggtttttttcgagttaatttttgcattgcttcaacactgcttctaccagagtccccattcaaacacatatcactatggtagttcacagtaacatggaagaaatcattacagagcatttgaactggataattttatttattcattgtggtcagacagcaagtctaattctgttgtcatttttatacaggtgatggtttaagaaaaaaaattatttacagacctcaacagcctatctcgatttctgtatttttcttatcaatgaaataataaagatgagcgcttcaaactatgcctctcacaactttcacaaagcatggcaataatctataatttatgtcactctcacctgtaaggctgagaatcattgacagaacctaaagggagggaaaaaagtcatctttctagataaagtgatgatagtttttcccagcttttaaaaaaatatatgcaaggaatttgtggtgaaatacaatagcattttaataaattgttattaacttgtattactaataaaaatttaagcctattgatctcacctgagaagcttaaaacattgaccagctaaggctttagtcacacatattcttagagtttctgagaaaccaatagcttttatgattttaaaaaatctatttacaaacatcatcttcacattcctctagccctgctttttttaaaggaaaccctacaggcaaaaatgcaatttttccaaagttggacatatggctgatgtcagaaccagcaaaatcatgttatacaaagccaaacgctgagttaaacctcccaatgctgatgttcatcagaccccagaataggtgtctgttacaggatgagcaagatgttagtcatagaagtagaactctgtggagatataactactcacctgcaaaatcaggtggctctgaaaatgaatagcactgtagcgttgggccaattcctgctgcccttggcactgggaatgcaatcttgtatggcaaatcaaatgagcagaaggcttggggccagaatactatcaagctcttctcaaactttaaatggatgagaagtcctgctcactgccatggaacatggcatggattttaagtgcctagtaggccattttattttgttctgttctttcttatttttggtaagcagagctggcagtatgagataaacttacataaacagtgagttcttgatttttatatttctcatatagatccaaaatcagcagcttcatttacacgtagctgtaaaactagaggagataaagtaatagcgtaggattatgttgaaaaatcaggatggggaagaatccccagaagagcttgacattttattaatccctactgaaaaacatgttccaaaatttttaaaaatgtccttctaatagcatatatatatgtatgtatgtgtgtgtatgtgtgtatatatatatatgtgtgtgtatatatatgtttgtgtgtgtatatatatatgtgtgtatatatatatatagttttttccatctagttttctctcagtagtgtctatttaatctagaaagcttctcaagccatgaacttctctatggattagattctgtgtattagagcgcaagtgagtatagctttagtccttgaatgagcagggaaactcctcaatgagaaaatatgggattttccaagaaattcctccagggcccttcctattcttaatcttttctctgtagctgaggataatagctgcataccttctagctcccccaattctagaaacaagaataataaagccttgacaatccatgagaagactttaatctgccctcaggattcccgattccagctcagtttctaatgttcctggatggtgactcatatctcaaaggcaattttggatttaaaatggttttccaaatctacataaagaatttctggattgtttgctgttttaaattagccaaaccaccctttctctctaacagcctgtataattgagagttggctatacattgtttgatacctgtaaaaagtaattgaacattctgaatagtgtattttgatgactgcaatttcaggtgcccaagcttgaccaggttgcttcgtttttgctcacagtggtattcagatatgcccctatttaaacaacccaataaatgaaaataatattttacaagattgataaatgaaggtgatttttttcccctcagagatctcttacttttaaaagagattcattgtattgttagtcatgtcctccgttgcattgaaaacatctgtttcaaaaaaaattcacatttatgggttattttcctcaaattattattttcctcatattgtaagtcacctggatctacaaaaataggctaaaagacagttattaccacgtgtcatattcaccagttctctcttttctttaaaaatgcttagatgtctttaaaatggtttttaagtgtttaaaggaatagtagtccatgcatagccctcagtatacctaagaagatgaagtatacttgtgactctgattgataagaatgcctgtaattttcaacagaggttactgtttcagtggtggcccagatatccatctgtcagtctttgtcaaatagcttatttgttatttttctgtagtctcttaaactgttattttttatttatttttattttttatttttattttttttgagatggagtctcactctgtcacccaggctggagtgcagtggcgcgatctcggctcacctcctccccccagggtcaagcgattctcctgcctcagcctcccgagtagctggcattacaggcgcgctgtaatttttgtacttttagtagagacgggttttcaccatcttggccaggctggtcttgaactcctgacctcatgatccacccgcctcggcctcccaaagtgctgggattacaggcgtgagccacagcgtctggccccttaaactgtttttgttctttccatacattcattccctacccccctgctttttcccaatgttccattctaaaagtgaataaaaaaattcacctaccaaatctggataacaagaatgttatttcattttactttaatctttgctattcttagaccttcttttcttcttcatcttttccaattgaaataaaaaagatttttgatgtatgtacaggctatgtttttttaaaagaactgttaaaattgtgcaacttcaaagcgtttccaaatgttgcattttcaaaaatgttttatcatatttttctttaaatttcctgttgctgtgtagtctcaatgatggctgaaggcactgaattttacattctatattgctttttgtgttccacatctagttagtagttataacttctcccacacaataacagtgcttttgtggaaataattactcaaagatgatttatttctaatgattttttcatatcatgattttaaaatatcttctaatttccacttacataaatgttttccttctctatttagatagaacacagatacatgttgattacatcctaatctatccttcatctacttcccagaaagatttcaggtggtttttgcaacaaaggcccattaaagttaaattaaaagttagagggaaacttttacacaattattccaaatatgtaaattaaggctagttactattattgagcattaaatttagctctgagcttactggaagccaatacagaaaagaaaacatgttatgttttataattcttattatctgacgaaacacagacagtttaaaatggaagacgaagtacaacattgtctttggtaatagttttagagatgatccaagaacgttcttcatgatcacttgtttcatcaacgaaccactttcatactgcctttgtgttcatttatgaaacacaattaaatattgctgttttggtctaaatgtgtctccccagaatttgtatgttgaagtctaccctccattgtgattgtattagaaggtggggcctttgggagttgattaggtcatgaaggctctgccctcatgaatggaattagtgcccttacagaagaggcctgagggagcttgtttgccccttccaccatgtgagggcacagtgagaaggtgcagtctatgaggaagcagtccctcaccagacactgctggcaccatgatattattagacgtcccagctgccagaactgtgagaaataaatttccgttgtttacaagttacccagtctatggtattttgttatagcattccaaatgaactagacaattgcatttatggaatacaatttgcaacacattgtacaaaatgatgtatattctggaatgagtcctcttcccactccttactcccctttccttacatacacattccttgcctttcctcacccccaacaatagttctgggacaggaagattttcatttacttctaaggaggtataaaatcttgatatggtttggctgcccacatctcatcttgatttgtagttcccataatctccatgtgtggtgggagggacccagtgggaggtaattgaatcatggcggtggtttcctccatgctattctcaggatagtatgttctcaggagatctgatggttttataagaggcttcccccttggctctgttctcattctctctcctgctgccctttgaagaggtgccttagccacaattgtaagtctcctgaggcctccccagccttggggaactgtgaatcaattaaacctcttttctttataaattacccagtcttgggtatttcttcaaagcagcataggaatggactaatacaaatcttaattcttcttgtaaacatttattgaacaccaactttgtgcatctttctcttttcaaattataaattatttcaaatgtacagaaaatgttatccctagaactcttaccaaacagactttatagaagtttgtgattagtaactatctgccaatagaagtcatttgcacataggtcctagaatcatagaattttaaaggtgaaaatgaggttaaagaacattcgctaactccttccttttacataaacattaaggacttatataggttcttatacctagttagtagaaaagttgatgacagaacttacgtcctctagtactttttctactataccataatatagatttgctggattatatatacattcaaactgtgcttctattcctgtatgtgataaacccaagcctcgtgtgatcttgttactctctatacagaacttacatccttgattagtatgtagactatcagtttgtttatttttttaagagatggggtctcgctatgttgcccagcctggtctcaaacttctggactcaagcagtctgcctgcctggtcctcccacagtgctgggattataagcgtgagccaccacacatctggcccagactttcaagtttcatagtgaaagtgtctggcagattaatgagttgttgatgcattcagtcaagaaatacttctgaactatgaggttcataatttgaggtttatctggttaaaatcatgactgctttcattagtgctttaattagttgaattctgtatttcagagaggcaaaactaggaactgcattttactgataaaattgagttatactatgccttttaggcaaatggaaccctcatttttttttgtccttatggtcattattaatattttgtttgttcttatttttgcttggagaaggagaactatcattgcattactgcaaacagtatatttatttacctcctgcccatgaacacttctttccctatttggagaaataagatactgtttgttcacagacctccctagtggtctgtctgttaagcagcggcagtcctgaactaagggcacaagaaaatggagctggtaatcacaagcaaataatgcaagacttttaacactttacatgacagattcaggtggggcttgcctactttattatccaaggtgttgctatttcctttcatgcctttggagatcccagaagaaggggagctagctgagtcaaacctctgtctcacagggctttcatgaacaatgacaattcatttcagcctagaggcaaagagggtgccttttcttacgagacttttgttcttattgcctggtgaatttttaaatcaaattggtggaaaattggaatgttttcctctcttttgtccttttgcatctccatacctccctccctcccagtatttttgagaccagatagaagcagatagactcatgggggattcctttgtccctaactcctatctagagtacttccttttcctaatatatatagaaatgatttgaaagaattctaactaacctcagatatggagataatgaccacgattaaatggactgaacatctcattcttatcaattccaattcataatcctattttatttaagtggttatctttgtcctttggaattccaatcagccaaaggatgccagtactgttaataataccgtatgccaagggaaattatttcctctgcttccacgactaccagggttcactttgtggaagctgtgtgataacataatccctcttacccaccacctcttttgggcaatatttgaaaaatgaaaaagggaaaagagctgggggagaaatcattcaagtaaatttacgatagtttcaaaaccagatttgctcattaaaaatagtacttgaaatagatagcagctgtggtttccattttgtaatttttttatgatctatttcatttctgttttctaagctacttaaaactgttgtaagctattgataatataattttccccaaattatttggctcctcatttcattttccctgctgtgttttataaaatttcatatcagaaataagaattaactagatatttttgaaatcatgagtaatttttattcactgtagaattagatttcttttaagaaaaagaaagctagtacagtaaaaatcagcatttcagatgtgggtggcaagaattaactagattttagagtaaaccgtagaatagtaccctcctctttgctccttaccatactttgttttctgagcatttatcaccacccgtcatgtatttatttgttcatcatttgtcttctgctccccactgaaatgtaacctccatgagagaagatgctttaactcctctagttacccaaagactctccagtgcctagaacagtgtttggcaaatatttatagtagttgctcaatatttgttgtattagtgattagcctgcatgagctatctggcttgcccatttcaagtgctgtgatgaatattctatgccggagaaatcatcctccagactggatcgttaccattatcttcatttggcattttattaccaacaagatagtaccccaggtaccatagtaaaaatgacttaagtgctttccatgtccatgtgcctttatattttacttaacaacatatattcttcacattgacatacattcattcagtaaatatttgttgaaaacttacaatgagtcagacacttacttgcccagaaatagaggcatagataagatattgcacctttactgtaactctactagaacacaaccctagaaaaaattcagaatctgtcatctccatagttgtggatttctctacaaagttgaaatttattgttgtttttgtgacaacaacatacgtttcctgatttttctgataccttttgattcatcctcatcattgatgtttctttttctccttgtacattaaatgcttttgttcaccaaggttcaaccctcacactctacacaagaatctttctgtgtgatttcacccactctcatatttttaactgtctatatgcaaatcatttctaactccgtagctatagcctacagttcttcctggaacttaaggcttgcataatgaaatgcctgctggacaattctacctagatgttcaataggcaccttcagttcatgtcaaaatcttaactctgctttttcttctaaaatctattccgtttttgattctttgtaggcggcaccaccatccagctactcactctagcagggaactgggtgtgaaccttgattcttccttctctataaatctccacatctcacaatctctgtatcctgcccgttttccttcctaaatatttcttgaatgtgtcacctctgtggcttcctaactaccattgtcctattcccatgttttaccaactgttgctgagacaactgcagcaatcttctaaatggcattccagcttccagtcttgtcccccttcaaatccctgcattcttttataattttgcccactgtgtccccctgcctggactgccctcccttgttcttttcattggatgaactcctgctcatccttttaaaactcaattcggccccatcaccggggggctatgaatatactttctcagttcttgcatggtgctttcagcatgttgttcccactgaattcccacactgctttgtctttgtttctttacctgcctgtctttcctattagatagtgagctcattgggagcatgtcttatttatctttgtagatccggcattaagcatgtcattgggaacttaataggcccttcagacatttttgaataaatgagtagatgaatgaacaaaagaacaaacagcaaacaaagggtagccttgaggtacagtataagtatatcaaagaatacaatattcttttactttagatatcaaccttataatttattaggagaaataaaaacacaaaagggcagtaatataccagcccacatgtagtctcatattccagtacagttttatctgactttgcctttttgatactgatgacacagggagcatctggggctagataaactgctcatgctctgaactatatgttgaatattttgatagaaactctttttgcctgtggcttatttgtcatatgccgcttgagtgtgaacttaatttgcatgactgcaataaatgaaaagtgtttcttatttcctactttgagtacataaatttgaccttgatcaatgtcagcaaaccaggcctctggcaaccacttcacaattttgactatccagagaagttcatcatcatctttagacaactttaccctggaatggcaggtttagttagtatcagtggagtcttgtcagacgtgtttcctaacaaaaatgacctcaagcaggagtgtgtggttttctctgagaaagcttttcttcccctgagcagatcatagcctccacaaatgtctttgaaacaggcatgcaaagattgctctatacagaagattgtgacaccgaacatgaggttgcttcgaatggttatcctaaagtgacctgccaaactgaagggcaaaaatgccactgctcttgaagtcttaaaatagtatctcttcttgttgaatccatgggaatagaaaaaagaaattgtggtcaggccatatgagaaggaatgccaaaaaaaaaaaaaaaagtcaccaaatccatttagcacttggtaacaaaaggtaagaatagacattgaatactgtactatttttagtatccattccagcatagtgctaagtatgtcttgcctccaaagtgtgttactccttctaccttctccatctctaacagtaataagcccagtcacctaagttcaaactctgagtcaactttgactcaagcttctcattgattccctagaaccattggttaccaatttagatttcattatctcttgaaactgttgtacctccaagtactctaaaattctcttatttgaacatgtccacttccttccacctttcctagtccacacccactctgcttctgcttttccgtttggtattctacaagcctttttcccattcaacttttccatctatctcatttctgtccctacccaactatgactctgctgtccaacatgtcagtacgtactcaaaagcactcctcattcattctctacccaattctcagctgctcctagccccaaccctgcaaataaccattgtccattttctcctctactgttcccggactaattaatgctggtaggcaacgacatataatagtagcatgttgatcaggcccactgcaagcgaaagaaaaattctaaattcattagttagaattttgaaaacaaaacatctgtcctaatacatctacttggttctgaaaaactgtgattactgtagttattgagaggtttctgtaacccaaatacttaactgggtcgtacatgaaaattatttttaagattaaaagtagagcatatattgtactgacagaattttctttaggatttacatgagtctaatctgatagaatggaggaatgtaattgaaaactaggaagagaaatctaggcatggaacttcatcatccaaacatttttttccctgattaaaagcaacatatcagcgtgtgtttttcaaatacaggcagtccctatcttacaaatggctgtagacagatgtagggcatattattgtttgaatcctgattacccaagtgggaaaactttgctttagatgtcagttgtttggaatccagaaagcattttcctaccaaggcagtgttataaatggtggttgggctcccctaggatagccaataatgttactgaaatactatacatttgcagtgaaacagtagtgaacacatttatcatatactactaattaaacaaaagcaataacgttgaataagatcattttatattttgggcttcaatggtggtgcttgaggaaaaacaggtttaattataagaggatgaaaaagtagatggagactgtgtgaaatctcaaaatagggctcatgagcatttttgaagacttcaaatgacacgtgttctttatcaagtctaactgattttaaaacttgtgaacttttacttccctttttgtggttctaagtgttttgtagtacaactgttgtgctatgattctggtcagtttttgactagtgatgaaaataaaacaagggaagaggataaaggaagaggatatggtgccagaggaaaattttgagaagagggggcttatatgcaaatatgaggattaaaaaaacaactttatactttagcaccacaagcattccacaagcaccagcaaccaaaggaaaaggagttctttcttgcttagttcttaggccatcctatataaatgtcctaaatagagataaaagttgcaataagttaaagaggctaagttgagccacactataaggagatgatatgtaaaccgcaaagcttgcatgagctgaggtaggaagagagttatttatttgcttttgttgttgttatttgtttttttgtcttcagttgtgtcttaatctgtttagtgttgctataaaggaatacctgaggctgggtaatttataacgaaaggagatttatttggtttacggttctgcagactgcacaggaagcacagtgccagcgtctgcttctggtgagggctttaggttaattccatttatggcagaaggagaaggggagctggcatgtgcagagaccaaatgacaagaaagagagagggaagggagcttacaggtttttgtttttgtttttaaacaaccagctttctcaggaactaatggagcaagaactcactcattaccacaaggaggacatcaagtcattcatgagggatccacctccatgacccaaattcctcccatcgggccccacttccaacattggggatcaaatttcaacatgaggtttgggggataaacattcgaactatggaaagttgtatggactatatcttggaagacggaaggatatgttggaagtgtgctaccttctaagtgtcaaaggttgagtcagagaaacatagagaaaaaaaggccaaggtgggcagatcacaaggtcaggagaccagcttggccaacatggtgaaaccccatctctacaaaaatatatatatatatgctggacatggtggcacgtgtctgtaatctcagctactcaggagactgaggcaggataatcgcttgaatccgggaggcggaggttgcagtgagctgagatggcgccactgcactccagcctgggtgaaagagcaagacactgtatcaaaaaaaaaaaaagattttagttctgttgcacattataaatggaatcctcctttgatatccttggaaaggatttggtaactacttatattgtttttcagtcatgttttgtattcacattcatttttacttggatatgactctgtactggtagggaactatgaggcaacttggctttattcaagttatataggtgtgatagatttcccaagatcacattaattgagctgtcagtgggggacaaaagagtatgattactctaaagaggaagaatagaggaggtagaagaagacagatatagagccacatagttaattctctttgctgtttaccagctgatgaaccaacaattattcaacaattttttactgtgctgtgttctaggcaatgtgctaagtgcttagagatgcagtggcaaagtacttggaatacagtagtacacatgatattacatctgccctcatatgttttacagataaggggacggtacagataagtagataaggaattataatgaattatgttaagtgctaatgtggaggtactgttgggtattaagggcatatatagaaaaatcacctaaatctgactttcagaattagcacacatcctagagcattctaaactgatatagaaagatgtgtcagagtgaaacaggaaaacagaagttaggcaagaggcaaatattcctgaaagaagaaataatgtttaagattcaatcatacaacaagaagcctagagagagtactgggaaaaaaaaatagccaaagagagatttctacttctgaaaattgtatagtaacttgtggcagaacaatgctctgccaagaatatctacataagccagataacagacaaaaagtctgtttgaaggcattggaaagtagccaagacagccagggcttgagaagttaaaatctcaagcaaggaaaactacagagaaatgaggcatatttccttttggggcatttgccaattcttacagcatgatacagagaagtcaccagaagttccagctatcttataggcttagagagagaggaaaacattgagggctgtcaaggcagtcagtactgaagggggccaaaatcctgaagagagtggatgagtagagaaatgaacttgcactcagtagttttaacctccaggcatttgccaaatccttaagctgttcatgggatgaaaaagcctaacccgtcaagcagtaagtgactgaaaagcagagtggagctttcccactcatagtataaaagaaatagaaaataatgttcagggccctccacagaggagcagccccaagaaacaccccagcatttcatttgggactcttaaagaacctaccctttaggaattggtatgaactaaatatagactgaacttttgaaagactgcaacttcacctatttgttcgttgattccttgattagattaaggtgatctacctctactccagctgcctataaatgatagagagaaccctctctggaggaaaatatcatctagtggctccaagatttctgcaaacaaaatgtctatatttaatcatgcattaattggcttatgaagaaactgaaccaagggaaaaatcagacaatagaaatagacctaccaatgagtcagctgttgacattctcatagacttttaaattagcatgattttttaaattactatgattaataagtttgagaaaatagatgacagtattgagaatctctccaaggaactggaatccattaaaaaataataaagaggtaggaggacagtgacaattagtgaaaactgtttcaataaggaaagagtagctgatactgacttatactacagtgaggtcctttggatatagtaacaaggagcacaggtactaagaagtcctttgggtttcataggtagatcgttggtgagtgcaggttcagtggagtggtgggtaaagaggccatgatggtgataaggtcagatttgaggtgagtagggaaggtgactatggaaacatgaaaggtatgatgggcttaaaattttggtccattaatttgtagtgtcataaatctattatatacgactctttaattttctctagaaacactcatcgacttgattagaaataatagagataggttgtattgttctccttccgtcttccccctttcccattccttcctctcccttccccttccttcttccagtcgttttccatttttacttccttttccactactattttacattatttttctttattcttctttccttttcttcctttctttgttttctaatagaagaaatagaaataacatttgtagattgaggagagagagcttgtatattgagagacctcgttagactcaaagcatgccatcataaatctgagatatttagaatatgtattccagtaaaatcggctaactaacttaatttttacagacatagcatacatcacagttaaaatgccttttagaggcccattctgttttacaagaccaaaattaaatgtatatatgcttatatacatactaatgtttatctgttatgtgcacatatctgtgtgcatccatgtatgtaacaactcagtgttttactgaagtaaatttttaggattgaaagaaataggtttctctagttgtatagactgcttatgagaacattacaattcgatatgtagagagatgatgattacaatttattagtccatcaccatttggaacaatagatggccaaatgtaattaaccattgaaagaaatacattttacgtgtcctaaatttcatttctaattacttgtaactgaaactctctagaatcttaaaatccattttgtcttatgaaaggcttcattgcttatccctgttgttgcactattactttagattagagtaacttcattttaaaattacatgtcaaatataatttgctattagtaacgtggaatgtgtggcttcactctgagaaaaaagcctgttcagcattttttaatatcatatacctaaacagagcttccacgatgattagatcacatctggcacaatgtagatctatttgtacttgcataatgcatgtgcatgtacacactgtgatattttacgactatttgggtacattgatttttctataaagagaactattatccacatctttttgcacagaagtacacttaaatattggcataggtaaacaacttactaaaataaaactcgtgcttggcacaactattactggtgtcacagattttacaactataatatttctgaaaagctagcttgaacgctttggaacatttttttctgagtgaatgcagaggcagtttggtgagctgtaaaacttctacttttcattttgtattctagtctaggccaaatcttaagtgtcactaaatctgattctatcttgaattgtggcccagtgtcatccccagaaggaggcttctccccagcactggctaggtaagcagcctatgtgaaacaaaggaagcggctttgccagcaagcaactattaagaatgggaaagagtttgaaataggctaacgaaatgcaaaaaagtaaatccaaagtccaaaagtagaggcagctttaactctgcactatttttatcttgtgatcctgtttgaagaaatgtctcaattcattataactgaagtaaaagtcactagcataatatggaaacaatcttaaactggtaaatattccttctccttacttaacataaaataaaacccatattaagatattagttcctcctcgtcagcaggggaagtctctgtatagactgtctgaggacatggcagttgactgacactagagtgggcaatcccagagactggaaattgatgtcaaaaaatttggttttgcccgctctgtttaatctgtaattagtcaaatttaatcttagtggataaggtatctgaattgggttcccaaaactcatctttatttctatttttttttttacattttgcaataattatgaatattttgaatatttttgaattttgaacataaaagttgcaagaatagtacttggaaatccctgtataccctttgtgcagattcaccattttaaacatttagccacattcattttgttatgcctcttaaatttttaatacttcaattactgtttcctaagagcaagattattcttgtaggtaacaatagcaaagttaccaaattcaggaaatgtatcattaatgtaatacttccatctaatcaaccatccatgttccaatgatgttaactgtctcagtgataccttttatagcattttctcctccaatgcaagatccagtccagaatcacacattgcatcgagttgttatgtcttcttagtctcctttaatgtggaacagttcctcataccattgcatacactgttaaatatgaagaaaactggtcagttattttatagaagattcctcaatttgtatttacctcatgattagattcaggttatgtacttctgtcctaactactagataagcaaagtatgtccttatggttcacatctggaggcacaaaatgtctctctgtccctcactggtaatgttaacttcgatcatctggtcaatgtgttgcctgataccttcattttataggtattattttctctgtttcaactaataagcaatctgtggaaagacactttacgaccatgtaaatatattgctctacatcaaactccccctctagccttaactactattgatgattcattcctgaaccaatctttaccacaacagttgcatgtcatcttgtattaatttcttttggaatgagaagaaaaacaataatttactctggtaattttctgaagaataccgttgatttcctttgacaatgttctaataaaggaaattgctctctatggaatcgtagtgatctgtatcctctgagtagtttactcattctaactcaaccaaaatgagcagaaattaaaagcaaatgatttttgctctagaatcaatacttatgttcacagtcagtatatatgctctgcaacaagttgtactctgggtatacatatacaaaatttcagtgttgcttaaaaaaaaagcatttttattgacttaaatggaagaattctatagttttttaactactttagttttctggaatttgtttactttaaaacttttcagcctttgcttttccatctctttaacaaattatcacctcattcatttagtcatgttctatttaatttatatatttttattcttttgcctttccacattgcctaaatccttgtggctaggattacttaaatttttctacatggttttcattcacccccattcttataaattatgtgtatcatttatttactaaatatcttggtcatgttcaagaattgaagatgagagttttcagttatcacattgaaaaagattaaaatttattatatacatataaatattatactataaaaatccttatgtaagttctgcaaatcagtattttatatatttagtgaactgcacaaaaggcaacttctattcagtgtaataaccctaattttatttcttaattttaaaattttaatcttttctacttaacattctccataaatagcttattgtagtgttacaatgaaagaaaaattttaacatcctcatgaatcctgactacttagtatatacatatgtaaggtgaaataggttaaatagcttatgtgactattttctagttacttcattaagtctctaatgccttttggataaacaaaaatgatgaaaagtaggtcaattggctacctcagccaggtgatcaagatcaacatcattagagatagtgataagacaggtagataatatgttctcttcatgcaatgagaatggcattttgcctctgtcttccccgagaacatataaccccagtctaattatgcggaaattgtcagacaaacccaaattgagggacattctacaaaatacttgaccattactgctcaaaagtatcaaggtcatcagaaacaaggaaagtttaagaagctgtcacaatctagaggagcccaaagagatgtgatagctacatgtgatgctgtatactggctgagatcccgaaacagaaaaaggatagtatgtaaaaactaaggaaatttgcataaagtatggacttcagttaatgatgacttatcaatgttggtttatttgtttgacaaatgtagcacactagtataagatatttacaacaggggaaagtgggtacagagtttatgagcactcttatactatctctgcaatgtttctttaaacctaaaattattctaaaataaaattttattttaaaagatatgtgtattgggaaagttaaatgttatatgaacagtgatgttggattcttaaaatcagaaagtccctgaaagtataccataaaatgttttttttctaattgtatttatttatttttttgagacagagtctcactctatcgcccaggttggagtgcagtggcatgatctcggctcactgcaacctcagcctcctgggttcaagcgattctcctgcctcagcctctcaaatagatgggattgcaggcacgcgccaccacacccagctgatttttatatttttagtagagacggggtttcaccatgttggccaggctggtcgaactcctgacctcaagtgatccacctgcctccgcctcccaaagtgctgggattacaggcgtgagccactgcactcggccaaatggggtttttaaatacttggtaaagaatagatcatgcccaaggtcactatcatctagctttatattttttaaataacaaagtatacaaatatatactgattattgtttcaagtactatatgttatagagaataagaataggaagtgattaaaagactatggtcccagtacatggtaacattggtgaacacaatttatacaaacaacagagaatagagtcttcattccaaccttttacacatccttagggaaagtgctatgtaaatgatacaattgctttatacttcatagggataccacacaaagggaacacttttaatatcaaaggattctaagaatttcaagaagtttactaaatgaggaattagaggaagatgcaggtaagtatatcataaggaaatataattttaaaagcttatcagtgctaactcaggctcagctattataatatgtagcatcttatggacaaggacaaaataaatctcactgaaaacttaagaccatttttcaccttgaaaactcaatgtggaattttccatgaagagcccttgtcatcaaagcactcagatatagtattgaccatatgaagccacactagtacttctggctcattggaatgaaaatatcatatgagtcagcttttaaattttttaaaaattctattattctgatcttaacacattattactacatgaaatttatcctcaacattttgactagctctttttaagtagactattgtacaggtatgacaagtatattaaaatacacataacaatttcatatttgtatcagagtatatcaaattaccaatgtcttcaaatattccatgctagaaatacctgtttgtagaatttctgtactggatcacttacctcttctttctatagcattttggcttcacacctttctcccataaatccaacagttcagttacacttttttcaagtatgtttaaatattggattgaaaatcatgtaccctgaaacctcataaaactctgtcaccaaagagcatgtcatcagattgagtgggatacaatacagacctggattatataaaaattatacgaaattgtacacaagcaattaagtctaaaatacatttctttactgctgaattataagcacggtattgtgctaggtactgtaagggttgaaaataagctgaataaaccataatctctgttttcaaggaccatatagttcattggaggaagcaaacatatatattcacatatttttattacactatatattcatatttcacaatagaggtaaaactgaattatatggacatatggaggagagaaggattgaattttactagggacatctcagaagcattaagggcagaaaaagtatttgaattgggccctaaatgaatgcaggaaacgtcagtaggtaaaaatgggctaggaggatagggaggtatttcagatagagggggcataaagatggaaaagcatgcaatgtttacaagtagcccagtgcaactagagtgagaagtcagatcctggaaggccaaatatatgactggggagtttgaacatcattctgtattagaggtttttgagtggtagaatttcaaaatcctatcttatatttgaatgtctattgggcaatcatgatagacgggaagagacagaaaccacttaagtgatgctataataaggcttgagtttatttaagtagatacgttcacttaattttaacaggttagttaggtgtggtaaacagcctctaagatagttccgaatgattcctgcctcctggtattcatgttctttgagtttggggttggcctagtgactggcttctaacaatagaaggagaaattgatgggatgtcccctctgagattaggttataaaaagaatgtggttcccttccatcttctgtgctcactctctgtctcacagatcatgagcttccatgttgtgaggacacttaagcagtttatagagtgggccacatgtccaggaaaacctggttgccagcagccatgtgaatggacttagaagaaggtcttgccctggttgaaccttatttgaaatcgaagccttgatcagtggcttgactataacctcataatagaccttgtgccagatacactacttaagctaagactaaattcttttttttttttttttttgagacagtctcgttctgttgcccaggctggagtgcagtggtgcgatctcggctcactgcaagctccgcctcccgggttcacgccattctcctgcctcagcctccccagtagctgggactacaggcgcccgccaccgcacccagctaattttttgtatttttagtagagacggggtttcaccatgttagccaggatggtctcgatctcctgacctcgtgatctgcccgcctcggcctcccaaagtgctgggattacaggtgtgagccaccgcgcccagccaagactaaattcttgacatatagaaactgtgaggtaatacatatttattgttttaagccattaaattttgccataatttattaggcagcaatatgtcattaacagaagtcaaatccaatatctagcctggtttatctttgtactaaattattgaatattttatttctatcatttctatacataatatggcttaaagattactgaattataaataaaatctagaattttctccatattgcttagtataatcttaactattatattgtgaaagctttgtgatcccttgcatttacagcttttagagaaatgaaagatacaggatttatatgtaagagaggtcttagaaacctattttgaaattaaacatttttaatattttctgttaatcctttttaggaaaaaaaaatttgtttataaagtttttactaaagttaaagaacactaactttatggattcactgcagctttgataatgaaaaaactactggaaaagaattaaagaagttgctaatcagttcattaatcaagtgtatctgctgcacattatactgaaacaaattgaaaaggatgctgtgctagccagaaactccctctcaaataaagtcaaaagtgaagataaactaaattgacttttcgtttgtggttgatttctatctaagtagatccatctctaaaacactgaataaagaaagttgccccatacatagattcaagactccactaggattctgtatcttaatactactgagaataacttgaactatatttaatcagtctgtctttagtttttgtttttcgttttgttttcatttacaacccacagaccactttcatttttaaatgttaaatatacttagaaagaagaagaaaaaaacaacatcaccttgctcactgcattaagacaactggttttgtaacccgatcaaaagaattaaatagctttctatatagcttaccctcccacaaaatctttcaatgcacaaaatatttgtcagtggtcagaatgattccagtccatcccactctctgtggtgccttaactataaaaatggcagtgaggcattgcagcttgaaaaaaatacagtcagattttcaattatgattagagtagatctcccagagaggtctccacagaaggcccaaggttctctaaagggtaaaaggagtgacaaaattctgacataaaacaatgtagtctttcctctcttttcttgataccgaccttcaaatattttggggtttttaaaagccaaattctagaagaaattgaaggttcaaaattggaattcgcttgagtttcattaggtttaagccagataccagcctatgtcattttctaaaagcagaataatttagttttaaagcaatagtacaagacgaacaaacaggtacctggcaatcacattaagactcccttggtgtagacagatatgtataacttcttttgacaggttattttgtttattcattcatttaattttggcacttaattttaaaagagcttagaaatcatagtcttttgatagatataattggtatgaatctgaaatcagtaaactaagatgcataagaaatgtaattttctttattttcttgtaactgaattaattctatcttaagaccctattctactggaaggtaccatggaagataagaaaacaaaccacaaaaaaatacacaaatttatacttacttcacatactgtccccaccatgttataaggatataatactcatccattaagacatgagttgcatgtttaccccattatagattatttaggattatgctgaatttacaagtgaaggaaatgagcaaagaaatgccactggataaacagtgttttgctttccagaagcattaatttaagtgactggcccatgattatccatctgctctatcagtgaaagatccctaaagacaatgcttgtcttctatccttgtcatactcagtacactgttcacattagcaagtatttgcccaaaattgctcaatttgggatacagaatagaaatatatgtacagtagtgagtcactgataggatctgagtgaaaattttttacatttttttaaggcttagatgaatggacacagttttctattgttttgtttacctttgtctggtttcccttcccacccccatgcacgtgctcatgtgtgtttaattaaacaaagaagagttccaggaagttgggaatgtcaaatgggaacagacaccttcgcaggagctgagaaaatatgctatatcatttatccttgtggaaacatgcaaaccagatttgaatagtttttaattgatttgcaaactttgcagtagaattttctggtaattagcaacttgctgagattaagtgaagtcatagttagcttcacagtggtttaaatcatatttcattgttttgcatgttttaaaagtcatgttgtaaattaaaaacgcaaagaaaaaatcaccaacttattaatagagaattgatcattatgcaaccaattagaagatataaataaatatacaaatcaatcacgtataaaatggtaggtgctgcagaatgttaacactgtacaggcaagtgcttgacaaataataatgagctataaagatagactagaagcaaaacagtaatgtggcagctttgttggaaatattttctagaaatgaagatgcatgaccttccgtacctttgttaatcatcagttatagatagttaaaatgttatatttacaataattctgtgacttttaaagtaattgtttatacaactacattgagcttactagtggcagtatgttcatatgtacatgtgtctctcttgagctctcaggagagagaaaaaatctgaggaagtgctagcaagcataagcagggagataagaaaaataaactatcttataagtacaataaaaatcacccatgcctcatggataacctaacttcccaattaaacatgacgtttcctccaaaatattaagcgacaaactagaattctgtttcggaagccaaggaaattaaagaaaaatagagtcaagggttaagtagaagagaagagacttaattacatttagcaagggtcccaatccacttagatacttactagggtactcagcacttgttcactgcagcatttgcatttagcacttttaaaattgggatgaaatgagttttatagatactagaggaatcattatgagatcacaaagaagtactgtgataccataactgaagctaggagaagggaaagcaaattcatatcacagaggaaagcaaacttccatcctctcaagttatctttccagtcaacattgccgcatatcacatatggtgtgcaaaaggggacagattaatgaagtactcaacaggaaggtataacaatccaaaatatgtcctttgtgactctctatccatttctgccatattccaaggaaatgcagatgtatcttcatttctatgccatgatatacttgggctgggaatgggggacaaacccagagtgattgttctcttttcctgtgttcatagtgtatatgtgcacacacatgtgagggtgagcctacacctgttcataccccatggcagtctgacttcactgattactttctagaatcttttttcctttatgtgccctggacaagagagtggacaggaaacatggtaacaaaaacaaagataaacatccttctataattctaaagaagcatttttctgtttcctcctaggagaaataaaaatgtataatttaaattaccaattaggatcatgttgggctttaaaatttttggggggtaaattgtatgagggttgcaaaaaagtcatgcagagaaagatactgaaatctcctaatacaacatgttgagaagaaagttaatgatcagtttttctggtagtttttgcatataagcctacttggaagcactgtgtaggcctaactgacgttagtgaatcagcagagagctgatttgaaatgcattatccgataggcatgagattaagcagtttgataggcatcttagagctgtttccatggccttattaatttgtaacagttgtgtggtaagttatgtcaacctcccagtcagaaagtcttcagtaagtttttcaggctccaagttgagggatgggtaagaccctgggacaacaccctagtggaggcttataggagagtttaagcatttctgaatgcttaaattctggatgctacattctggatgctacaggcccagaattccacactaaagtatttgtttggagaactcaagtatattatgggtatcttatttgtattatgtgtaagtaaatatcaacataggtttgatcatttaatcccatatcctgattttgctctaagcgaaggcagttatttgagtgccagctcagaaaaggtaattcactattacctgttaagtgtgatgaaacaggacttctcagcatatctttcttgatggtattttaggttcaaagctgatggattagctttttgccctttcacacattctacctatcagtgacaccatggccaagggagacaatccaattcacttccctgacagaattgtgggtgatggttatatcattacgtatcctggaatgcaagactctgcttgtattgatcttaaacatataagctaaactcagtagcaaaaacataaccgatatatggtggggaaaacgacaagggagtgttttctaaacccaagaaatactcaataaataggctaagaccaagatgaaaagtgcaaagaaccaacaagacaagagtagaaagaatgcggggctcaataaatggtattattctcagaaagtatattccattatctgttgttgtagaacaaactacccaaaacttaatggcttaaaatcattgttcacgattctgcaatctgggctggcttcagcctggcagttcctgccactagtctcatctgaagtcactcacaaaactgcagcccattggtccagggtagtcccattcatatgtttggtggttagttggcaatgtcagcccagcatttcaaatttcatggcttctccagaagggagctcaggcttcttacatggcgcatgtaatgttccaagaagtcaagaatggagactacacagtctcttgagtcctaggtcagaagtcacacatcattacttgtactgcattctgttggtcaaaggagttcacaaggccagcccaggttaaaggggtaatgaaatggattccacctctacatggaagaaggtgcacatagtatgtgtccatatttaaaatgtcacagaatttacaggaatatgaaaataatcatggcaaatgtggtgcattcttaggaagaatttttttttcttttttctttttttgagacagagtctcactctgtcgaccctgggctggagtgcagtgatgcgatcttgactcactgcaacctccacctcccaggttcaagtgattcttctgcctcagcctctcgaatagctgggattacaggtgtgcaccaccacacccggctaattttttatatttttggtagagatggggtttcactatgttggccacgctggtctcaaactcctgacctcaagtgatccgcccacctcaacctcccaaagtgctggaattacaggcgtgagccaccatgcctgcccaggaggaactatttttaatgtccaccattgtatagtgctcccggtacagcctctatttaacaatttttaaaatgtctctacatattttgactctcttaaaagttaataataatgagaaatatttacattgtattcattcaataaacaagtactatgatttctctatcgcgctcagatctatcagaaaccttaaatgtaaatagatcgtttgatgctttattataataattgttaaacattcttcctaagtgcattattgaccattgatagaaaagaaattgcttcatgttatacttattcatcaaaagcacaagaagtgcccttccctgtcaaactccttcaattgtcaccccagcacttcactagagatacaaataatagcacatgaaattgtagctggaagggaaggggaagactggtaaggcttatttaaattgcattccaagcatagaaaacatatcttctttccaaaaaatgaaagctagtacaatattaaatcagtaatatacatacttaaaggcatattattttatgtgatatgttaaccatgacatagagtatctcaaaccaaagtgattcaattgtcattaccatcaacaaaatgaaacttataagtggattgttagcagcctctttttagtttgttgtagagtgttcctctaaagagaggagaggccagaaatcatctcagtacacagacacagtgttgctgcatctccatttttccacaccgattttagtcttgatattacttccctgtggaggctgtctgaaagctaaaagcctatacagaagtaacttaggccaggtcatttttacttactaaaagtcagttttcctataacatgtaccacaagatgttactttaacagttttggttcaagggtcaccagactgtacagactaccagagcttcagcagtggcattctttcaggtggcactctataagttgtctgaatcattgggttaacattctcttcatgttttcatcttagaaaggcaagttaacgtatttttaaagaggtttaagaaggcttaagaaaaagtaaactttttttaatgcattgaaaaaataattttacaatttattcaattcccagagtttttattacagacctactatgtacacaagcatggtgtacccggcagctgtgagaatagcaaagacacagcctcagcctcccaaagtgctgggattacaggtgtgagccaccgcactgggccccagtagatcttttctgtgtatattttcccctactcctctcatctaccctttactccatcctaagtgaatgatgcccttttctctgactatatcttacctttcctacctctatgtctttgttgatcactttcaccctagccactcttcaaggctcgtttcaaacacagatttcttcatgaagacttttctcctgaatacacacactgctacctcaaatccaaagctatttctccttgtttatctcccattgcaccttaattcctctttgggctagagttgtctctgtatcttgtctccaccatccaccaaattttaagacctgaaagtagagacatcattttgttctatctcctaacatactttgcagttaataagaggcaaaataactgtttagttgaattaaaaatgaatgtgaggaaatattgtggccatctgctaaaatgcataggtaacaatgttggaaaagaagtggctcttttttaagtttgatgaaaaaaaaaaaatatatatatatatatatatatatatattcttaaaaaattaatcacttgtccaagatttaacagctaaactaacatttactgtatgttcattattctgcataatatgtttctcatatatgtaaaagcacattatttagtcaaaactatcatattaaatttctcccgtaattcctaagggctgtcagctgctcattaaatcttgattttctgtcaggaggaattaataatcttgcctttgagtgaatttagaagcaatgagggattgagcaggaatatttgaataccctctcggtggtaaattggatatccaattttcaacttagtcttaatgggaaaaaaagaataaattgaattcagaagctgttctttactttttaatatttcctccccacttttaactgagttaaaatggaagggtatagttctttctcagtggtggggaaaatcaactttcattcacttagaaaagtttgtcaaattcgaatgagacttaatatatggacaatctatatgactaagtctataaggtgatcctttggaaatcataggaaaattcagtacaataacacaaaaattgatttgcatgaggtttaaatcgtgtttttctaaaagcaaggaatcctgctcctccctctccccaaatgaattttgttgtcaaatactggtactaacaattattgatatcacaactcagtctctaaaagcaaactgtcctattattaccagagaggtgctaactcacattaacctaataatatatagctcttaattttcagttttcatctttcatcattttttagctactcatgtcttagatttaaagtcccttaaaattataaaaggttgagagactgataaacaggcataaaaccttgtagatttttttcccctccactctttttttctaactaagctacacagtaccatcacgtaccatccatcagtacatttagctgtcatgacgctgccaatagaagttgtccatccactaggcagtataaaattacaatcacgatcttcgctgggagtggcagctcacgcctgtaatcctggcactttgggaggctaaggcaggtggatctcctgaggtcaggggttcaagaccagcctggccaacatggcaagacctcgtctctactaaaaatacaaaaattagctgggcgtggtggtgcatgcctgtaatcccagctactcgggaggctgaggtaggaaaatcactcgaacccaggaggcggaggttgcagtgagccaagatcgcgccattgccctccagcctcggcgacagagtgaggctctgtctcaaaaaaaaaaaagttacaatcatgttctcagtgaggcagtaaggtggaagagtgtatttctttctgtgtagtatgactatatgacctcatgtgtgtcactcacttgcacttattttcaaataccaggcagcagtttgcttgaagttaactatctgttttatcatgcaacttaagaagaagttgtaacacatgcaactccaaattattcttattcataactctgttctatagtaagcatttgaatatggatgcagctcatgtgatgagcatcattctacttgacatgaaggaatgagatccaactgcgaggaccccagtcagaaagagctgaaggcccattgatgcctcaccttttctccctgcttcccccactcttgctagggatcattggcaccaccactcagactgatggtaaaacaagaaattgtcttctgtctagctcagacacatcacttgtccaactcaacccctgctttgggtacaggaagttttaatctggttaagttgaatagagtttgtcttctagcttttgctgtgctaaagcaagagaagtacaaatgtcaacaagcagaataagaagagtataacaagaaatggtaagaagtcaaggccaaaatctagatactgacctgtggataattgagaggtgtcagcaactctcttctaacatcaaacagacataataaaaacctaacaaaagatgttgaagtctgaccagcatacctcttactttgcataggtgctgtttggatttctatgcaagcctgtgcttaaaatcagccttcagattgaatgttgataacctttccttttttacatgcctcatttcagtttatggcattccaaccttttctccctcgtgacgaacacttttttgtatcaatgtgaggcaagctctgtcaattcatctaatcctcaaagaatttttgcagaataagtatgattatccccattttatagatgaagaaatcaaggcccagagaagttcaattagttgcctaaggccatacatctggcaaatgatagagttaggagttgatcccagatctgcctgattctgaaccctttgtttgatctttgtgttgttccatatcatttccctatttaagaaactcatttatatttgcactccataaatatcaagcctgtcgggactaagttgtaatgagttcagcatcaattcctgtttactggtctgggctaaacagtgctgatagtaatgctcatgtgaccactgggaaaggtccaagttcatgctctaatatctgacaacagaaactactcccttctagagaaaagagcagacctgaggataccttgtgcaatccaaagtcaaattccctattcattcattcattcttattttgtgtgtgtctctctctttctctctcttgtgcacctatgcacacacaatttttggtcgatgcacaattttaaggtcatttttaatctaaagaatttgttcccctcttctttcctgattacatggccatacagcctgccccaaacagtatgactcactctccatgactcttctgcggctctttgttgtgagttttcattttgtgcctcatttctgaatatgctctaaagagcagggatggcctttggctagaaagaatggcatgtcaggagggttccacaagccatgttgcttttctgaatcatgaaaaggcatcagcactcagtgacatggcccagttttctaatctaatttaattgaatgtacaatgatgtgggcactggagattaaatacaaccccacttctctgcaaagttcacattgcctttaaagcaatgtaatatttttttcatttcttatgaatggttctgtgtatgtgtcatgtatacttttacttgtattctctgtgcaaagtgataccttaaaaattatctgtaaaaagtctaatataacttggtcttctggaatatggcctgatttaattaattgaccaatattactttaaaccattatattgcagtgaaagttttttcttgtcacagtaggaactagagacgtgtcctaacaaagtactaacttatttgcaactgatataaagtgaattaatatatttgttacttttaaaagagagtgtattttggaattttgcagttatttgtatattaaggcccacattaagggcctgcccatttataaaatgacgggtaattttcccaagtgctgataaaatattttatcatctaaatttgaaaagaaaaagaaactaattttaaaacatttctaatttataacattttgtgactaacttactttttatttaatttatttcctttcattcccctcactgtgatccaatttgtagacaggcaggcttgctaaatagcttcagcatttgggtttgatttactgtgaagtagatcttagaaattaaagtttcaggttgaaatttgcctttcagatctccttgcctaaatatacatgtaaatttgggagtaatctaacatgtgcataaacacattcaaactattttatagctttaaaaaaattatattgaaataattttagacctacagaaaagttacaaggttagtccagattttgatacccccttcacccagattccccaaatattaatgttttactgcatttcctttattaatcttttttctagaaacacatacacacattatttttttctgaatgtttcagaataaattgcaacatgatgccccttcacccctgaatacttaagtgtgtatttcttcaaaataagaacattcttttgtataatagtacatttatcaacattggtaaatcaacattgataaattaccacttaatctatagactttatttaaattttatcagttctcccactaatattctctatagtaagagaaaaaaaatcccagcccacatgttgcatttagttatcatggctcttcaacctcctttaatctggaacagttcccctgccaaaaatgcatatcctgaatctaatcatgaggaaacatcaagcaaatccgcattctacaagataatttacctgtactctttaaaaatattatagtttttagagctatagtacatctccaagtaagcacataggcatatctacatttttaattttctctaagaaagagcaacaattcaaaataatccccaagtatgttttaaaataaaggcttctttttgaaagtcaaagacaaatgctcttagcctaaggtttcatttaaacatagaatggctatttcaaaaaacagtattacataaaatatgggctgggtgcagtggctcacgcctgtaatcccaacactttgggaggccaagtcaggtggatcacctgaggtcaggagtttgagaccagcctggccaacacgatgaaaccttgtctctaccaaaaatacaaaaattacctgggtgtggtggcgggcgcctgtaatcccagctactccggaggcggaggcaggagaatcacttgaacccaggaggcggaggttacagtgggccgggatcctgccactgcactccagcctgggcaacaagagcgaaactctgtctcaaataaataaataaaaataaaatatgtattatataagttagggacaatctggtctttcatatatagacttcagacaattggttgttcattctggagttgagcactatttctctcatgggctcttaagctaagaacatttagctacatgtcgggtatgtttcttacattctgcctcatgaccatctcccactgccatgcatatgacaaagacacttaactctgagccccaaatctagaggagagatctaaatgtcacgtgaagttcttaaaaacctttcttctgaggagttaacaagggatattaggaagattcctctgcccaaaagacctcccaaataacctctgccaactcaggctgcattaagttaaaccagatctgtctgtaaaatagaaatgagaatagctaataatatcaatatttcatacctttattttaactactcttctctggctactttgtgggttgtgagggaatggaacattttactgaggagccaggtgaatgaaagaagacatgcagagcaagaggtctttggtgagagggcctgtttgagcccctactcaagggaattaggagtagcatgagggccctgtatatccacagaggacattcatttttaatttcctctaagaaagaggaacaattaaaaataatgcttaagtatgtttttaaaaagacttttttttttttgaaagtcaaagagaaacgttgttagcctaaatttttatgtaaacatagaaggtgattttaaaaagccattaaggaggcaggggagaggtatgaaaaaatagattgaaggccacctactttacaattttgcctggtaacaccaaactaggcagccaaagcctggcttcaggtttgtcacagctatcggttatgataaacaatattaccatcacttcctggttgtagtctgcatgaatttgaaaactaaaatttgcagtgttcgggagtggtggctcatgcctgtaatcccagcactttgggaggctgagacaggtggatcacctgagatgaggagttcgagaccagcctggccaacatggtgaaaacccatctctactaaaaatacaaaacttagctgggcgtggtggcgcacacctgtaaacccagctactcgggagattgagttgggagaattgcttgaacccgggaggtggaggttgtagtgagccgagatcgtgccgccattacactccagccagggcaacaagaacgagactccgttttttaaaaaaaaaaaaaaattaaaattaaatttaaaaattaaaattaaataaaatttgcactattatgattcagtaaagcaggaatgttataattggttgttttctccttttttcctctgtaatactatttttaggaggatctaggtagatatctcactctgattattcccgaagtatgaagtctcccatactggctatttacatataacttaattcataagacttttaagaaatctctttttgccttctccttattctccagactggcattgtgaagatgagagccaacaaattatacctcaaagtctggaaaattagtcaactgttccacagttgtgcatgaaacatttctgactttgtgatttgtgaaagtagcactgactcagctaaggatcatggaaagagcatagacttagatcagaagactcattctagctggtaactgtgtgatcgtgatctgatcactaagactctgcgagccttaggagtctccccttgcatgaaatgaagttggtgaactagatgatcttcgcattatctcctaagttgtaaactcaatgattttgagtataggaattaacaaagccacttaaggggaaaaaagttcccttcatttcttgatgaaatacttattgagctatgtaccatattccatagaaaggaaaaactagatatcttaaccctactaagttgtttagtgaaaagaacatgaaaagttcagatgaaaagtcaagaagtcaacataggaaaaaacagataaactaataaactgaataagtaagtaatacagcttcaattaagtactggacttccaaatggatggaatcatacctttcagggctaaattgtatttgagaatacctactctgaggaataggtttttatgctctggaatcaacacctcaaaattcaacatttaattcatttcactcttcactcattactcttttgtttttgaatatacacatttttcttttttttttttttcctttttttactataagataaaccaaaaataaatggctaggtagatggctggagtttgcttgtttgttttaatgatagtataactgcatatagaaaagcaatatatgtgttcctatatgaacaacccaaaagaaaaataacttttaagtcatagaactttgaaggtctgcaaatagttgttgacttagttattactacgtgtattagtttgctagggcagttacaataaatgccatagacttggtggcttaagctggataaattaatttcctcaaaattctggaggctagaagtccaaaatcaaagagtcagcaggtttggtttcttctgagccctctgtccttggcccttctcactgtgccctaatgtgactatccctctgtctctatgctctgtgtactaaggacaccagtcagatttaacttaattactactttaaaggccctatctgtaaatactgttatattctgaggtactgcaggttaggacttcaacatatgtatttggggaagacacagttcagcccataatactgcatttatctttataataaggaagaaggatttatattattctactgttttgtgtgctgaatgtatttttaactttggttgtacaatttcccttacacctgcatcagcttatcacattgtgccaaggatgtgaaatgaattgcttcaaaatacaccctaattaattaaatattcacaacatttttatagcatttgatttttttccttgttaaacataacagagaattggatgttgttcacataccacagataagccaataaaccagacattttgtcatactctgtattgataagaatttttttggcatggaaatgatgtattttattgcctttaacttctaatacccccttaattacaaacataatggatgttttactggggatattgtatatgcagcagttgtttaaacctgaaatagaaatgctaagagggaaaagtattcaagtccagtgtagcccaatgctgaaagataaaattgcagcttttgacattttaccaaattattgattgtgttctctggctggctttaaaaaacttaatgcagtgagtaggttaaaaaaaaaaaaaaaaaagaagaagaagaagaaaatggctgggaaagcataaaggcaaaacagttttaaaaaagtatgagaaagcttaaggcctaactcaaatgataagcagtagattttatggcaatggtgccagacagccggggtttgtatcttgactcttcctacttaataactcactatcaggcttgatgtgataataaaataattcatgtaaagcactcagcacatacctggtttatactaaactcaacaatttctagttatatacatagatagacatacactagtacatgtgtatatatgtatatgtaccttgtatatgtatgtgcatatattaatatatgtatgtatgtattcatatacataatatgtatacatattcacattcattttcatattctccagcctccgtttggtacactacaacagtgtgtgtagttgaactaacagctggttctgctgtcatgatggctagaacagcaaagtcagccagagaaaccagcctcaaatggtacatctttctgtaagcagatatatatgatctatagcagcacgtccagtgattgcctcacagatactacttctaacctatgggggaatttttgcatagaaatccaaatcccctcctacctctcctctcagtgcttgagcaatctcttgatacatataaagctttgtaactatccttaagtttttctctggtctacatatggcctttatgcttaactcattgttaaattctcacaggacaaaggctacatacattccatatataacttcagcagcatctgctataagctttcccataccttatacactgaataaatcatgaaggctgatggaatcctgaaatgaacccataatccaataaaatgagaaaggctaaagacctaacctgctctggactcacattagtctagaagcttcaggaactcactgaaaggcaagatagaataatggttagtatatggactacagattcaggaatacctacatttgaatcctggctttgcaacttatataacttgggcaaattatttgacctctctgtgcctcattttcctcatctgtaaaatgataatcagattatatgtttcccaaggttatgaagaataagcttattcatatttgttatgtgcttagattagttcctggtacaaagtaagtgatagcacttactataagtgtgtactacataaataaaataaaataatgcctggtgtctcaacgctggcccacaaactagtctactctacacaggtcttccagaccaagagtgactataaacctaatagacatctctcaacaaggcagctgtaggtctttactgttcatgttgggttttgccagcagaccaagtgttatgaattggctttagccaagggtttcctgaagagattaaaaaaaaaaaaaaacaggctggtggaacatttggtatgtgtgtttctttagtggtttacagtctgtgtttctagtgtctgcatcattaatatatttctctttctggatttagaccctgtcattactcatctgtgtctgttttgacttaaacccatcactggaagaaagaaagaatatgggtctcaatgagttctattgcttcattatggtgataactttagtgcccacaaggaaatagttgcatacccactggctgcaaactaggtctgcattcttcaggaaagatgttatatggcagcctttaagaaatgcagtcttcttttaccttcaactttgtgtcttatttcactctacagtttttaagtgaaggagataagaagaaagagctagctgcaaaggtgagagttgaaatatttttacagagacatcattataatgaacatgatggactgtagttgtaaatagggtgagtgggagaaaacttgaagaaagttagaaacagatgaagaaaaggatttcagataaaaatcagggaaatcaatgtcagtatgggaaaaaagatagtaaggtagaaaaggaacttttaaatgaaaagaatgagtaaaagatgattttatactgattttaaataaaactctgtgtcaaagccttttgtaaataataaggttatagatgattgtcatggtggttatgtttgtttagcaaagactacattaatgaaatggctaagaagcaaaatcttaccaggttttaaatatgagtacactgtgtctattgctctaatttttgttacaaacttaccctaaaataggtcttttaggcaacaacagtaatagcgccaatcgcagttactctaccattctaccacagaccggggaacattctcatgaggactccagcattagatggcccattttagggcacaacacttcagccaaaactttggtagagaagcagtttcagtgagtcattcatgatcctaaatcttttggctgtggcctcaagatctcccctctgttcccagtgggaattatggtagagagacacagttaattgcctgtggattttatgactgtccccttccctgcagccggaatcatcatggaattaaacatgcagggaggttatcaagggactctctcttatgcggactgagaaacttaggttagaccctttgaagaattcactggactgaacatagagtctctactgagtaaaaggatctcctctgttaagttgttcatcatccatttatttattcattcaataaaaatgtattgggtgctgtatgagtttcctagagctgctgtaatatattaccacgaactgtgtgacttaaaacaacagaaatttattctctcacatttctggaggctagaagtttaaaatcaagttgtcagcaggcttgatttcttctgagggcgctgaaggagaatctgttccatgtctctctcctctctcctatcttctgttggttcccaacaaaccttggcattccttgcattccaatttctacccccattgtcacatggccttcttacctctgtgtgccctctgtgtctccaaatctctctcccctaatgacaccagtcactggattaaacttatttccaaatatggctacattcataggtaacaggggtcaggacttcaacatgtattttcgggggacacagttcaacccacaacaggtaccttttttgtaccaaatacaatcctaaatgctggggatagaaagatgaataatacgcggtctctgaactcaaaaacgtcatttaaataggggtagacataaatatacaattatagtgtcacaaatattaaattatatgtctcaacaaaatgctatgggaacacagaaaaacagggcaactaacattgtctcaggaagcccaaaatgtttcactgtgaagctgccttttgagttatagggtaaaggatattggagttcatcgattaattcatagttgtgagtatgcaaagggcattgcagaggaatggaaaaatatgtataaaaacatggtatcatgaaaagactttgtatctttcaagatagggaaggagttggtgtaactggagtctagggttagttgtagggagcggcagaatacatagaagagaataaacaggagatggtagacggcagaggacctgtacaatttcatctcaaagaattggggctttaggccaggcacggtggctcacacctgtaatcccagcactttgggaggccgaagtgggcagatcacctgaggtcaggagttcaagaccagcctggccaacatggtgaaaccccatctctaccaaaaatacaaaaattagctgggtgtggtggcaggtgcctgtaatcccagctactcgggaggctgaggcaggagaatcacttgaacctgggaggcggaggttgcagtgagcagagatcgtgccactgcactccagtctgggcaacaagagcgaaagaattggggctttataacatagaatgtctctgccaagactcttggggatgtgttttaatccttaaagtaacaataaatgtatttaagtagtagtataaaacgaagtgaaacagtagttaataaagcatcttgcaaatttggaaaggccattttgattttgagaaaattatttgaattatagaataattttaaggaaatgctttttaatttatttttaggatgcataggagctcaaactaagttaacaagattcagtcatccaaaccattgcctagtaggtgtccttaaggacccagtcttaataaacaaatacagctaaattataattggcatatcaactgtatgtaaattgaagcttataaagtacttgaggggatttgacaagtttgttctcttaagcattttaaatattactcatgttagttatactatttattatctatggggaaggagtttgctaaaccaaggtaaatgtcaatgctagttcctagacaactatcatgaattctgaattagtcactttttatttattcaacaaatatatattacttaacatctacgaacgagattatgtcctaagtagcaggaattcaaagacatgacaagggcacattcatgtcctcttataactcacagtctagttggggagaccaagatggaaacaaagaaacacattaaagtttgttgagttagataatggtggtgcatacagggtgcttgggtgaatgcagtggaagacccaactctttgttgaagaaggctttatatttagcttgcgaactttgaaggataaaaagtggttttcctagaggacaaagaaactggacagtgtagtgaggatccaagggatcaggcacaatgctttaaaaagttaggagaaatgaaggctaagccaaagtcccagaactgcaaaaaattaagtccgtgtggttttggttaggatgagaggaggcaaggtaggagatgaggctggggggttggccagcagccagtaaggggtctcatacaaaggagttagaacttttatatgatgtacgatccactgatttaagcagaagagggccatgatgaaattgggttttagaaagagacctctgggaacaatttggaagaagaaattagagcagtggttttcaaacatttctctttttttttaacacagagaaaacttttctaaagaaaatcttacatctaaccaagatagataaaataagagtgatatttctttcaaataaatattatgcaaatgaaaacaggctacttcaaactcaaaagtgtcaaattgggggttatagactacagcacctgtgttatattagactcagtatcaaaattatatctgtacacagttagttaggaattatgatggttcaactatttttcaactttacaatggtgtgaaagcactatgcattcaagtagaaattgtacatctctcatcatgctgggtagcaacattgaggcttagctcccaatcagctacacattttcagcttctgttgggtttatcagggcgtaaccccattgtaagtcaaggagcatctgtatttattaccgtactatattgagacaattctgattttctgtaataagttgtaaacaataacggttcaaatgactctccctgtcatgtcatgaaacccttcagttgcattggtctagaaatataaaacagtccgggtcgggcatggtagctcattcctgtaatcccagcactttgggaggccaaggcaggtggatcataaggccaagagatcaagaccatcctggccaacacggtgaaaccctgtctctactaaaaacacaaaaattagctgggcgtggtggtgcgcgcctgtagacccagctactcgggaggctgaggcagaaaaatcgcttgaatccaggaggcggaggttacagtgagctgagatcatgccactgcgctccagcctggcgactgagtgagactccgtctcaaaaaaaaaaaaaaaaagtctgatagtgggaaaaaatccctaacaagagtcaccacaactcacagtctttactgtaaatataggcattcaaaactttcttaaaatgctaaaagcattcatagtgtagtcttacatgtctattttatgtgttcacttttcgtttctacgtacacggtagacatggtaaatatctgttgaattaaaatgatcaaaaacaaagtaaagatttaaccaaaaaaatacagacaatataaaaccatgaagattcaaagtcaaaagtagctatagtctctagcaaggcagatgttcactggcatttgtcctctggtctgacttccagccccaatttatataatcctgacctaccagaaattgggataggtatcacttcatggaaaaagacatcatgctttaagaaagaagagacacatataaacttgtatggggttagaggagctatgtccctctctagttccattagaaattgctgttaagaagggttgggagcaaacctcttccaatcctacccacgtctcaaggcctagatcaaatttcacggtctctgtgtgacacactgatatctcaacacttcctgaaggtgacccatatgccaggaacagcactagatccagagatacaagtattaaaaagatccctgccacctctcatctacatttctagcatctgtttttactcatttgccatttgatcatttcccatctgtatacaagactttaaggcccatgagagcaaagtttctgtaagtttaattcaacctactttttttggccacaagctttgtggcaggcgccatgttaggtattaagaaatacaaagatatagaatacaagtcctccagtagcttgcagtataccatgtataaacctcagatggctactaccgtatacccctcaacagccagttagctgtgagagtaaattgtaaattctttcatgctctggccagatttaaaaacatattaatgtgtatattcttttccaactgtgtcttcttttttttttagatggagtttcactcttgtcacccaggctggagtgcaatggctcagtctcggctcactgcagcctctacctcctgggtacaagctattctcctgcctcagcctcctgagtagctgggattacaggcacccgctaccaggcccagctagtttttgtatttttagtagagacgaggtttcgccatgttggccaggctggtcttcaactcctgacctcaggtgatccgcctgcctcggcctcccaaagtgctgggattataggcgtgagccaccgtgcccagcccaaatgtgtcattttagatttcactttcttcttgagaccatgatgatgccacatgagaaatccttaagtccagctccaattatactgcatatcctagaatggaccattacattaacaagaattttcatatgctaaccatgacatgtacttcatatcatgaatgtagatggctaattttcacacattaccatgcatttcagcattccctagagttatctgaagcatctggggggaagggggagagaacctttaagttttctgcttctgagactattttgttgttattggatatcgctttgacccccttcttttagtgcttatcactaggcatctgccgtatttaatgatgtgtgtcatttcatttagtatcactgacttggatcaattcctcttccaggtttctgtactgtcttgatacatgtatttgttttgctttgaaagaaaaatcaacaattgaattgccagtgatagacatatgagtaggaccattcttaatggatatgtagagataatttctcttcctttaatgtctgtgaattatcatccactgtgatgcatttaaaaatgcaactcaacaacagtagtctactgacaaacaggtgactgctgcctgtgatgtgttttcagttgttggcttttctaagtagttacttgtcagagagaaaggaaaaaggatgaaaatatccattttgacacctcttgaaatgtgtttgttgactgtctctcttttaaatcgccctgtacctatttggcatcactaatcacaatgctaagtgactttttactttactaggcattaaacttgtgctgcttaacctttgagcatcaaacaggcctttccccagcaccctgctgtatctttagtacaaaactcctgaatcattatccatcttgaggatctgccttgccttagaggtactctgacatttgctaagacttcccattggaccttgcagacatttccagatcatgacagtgtcatttgatattttggttttaaacatcatcagagtggcttgtgctgaagaaccagaactagaaagaaaatgtaaaatgaaaagaaggctattgcctctgtgctgattgttaagatggcattggaaacatttttgtttttactatggatatagtcataaaaccatgaatatttttcaaaggatcacagtatgaaatacagagccaacggtagaatatattaaattagcccatttgaaagagggtctatctgtaaataaaccttgcagttaagaaagccaattatgataaaactgtatagttacctggtaaactactgtttataaactactttaattttacaatatcttatttgaaccttacaagaaatgtgtgaacatagtaaggtagggttactctcctcattttgcaggtgaggagactgagaattagaaaggacatgtgatggccgggcgcggtggctcatgcctgtaatcccagcactttggtaggcggaggcaggcggatcacctgaggtcaggagttcaagaccagcctggccaatatggtgaaaccccatctctactaaaaatacaaaaaaaaaaaaaaattagctgggcatggtggcgtgcgcctgtagtcccagctactcgggaggctgaggcagaagaatcacttgaacctgggaggcggaggttgcagtgaaccgagatcgcgccactgcattccagctgagtcaagatcccgccactgcactccagcctgggtgacagagcaagactccctctcaaaaaaaaaattaagaaaggccatgtgacttactcctaatttcctggcttgcatgaggctgagccagaatttgagcctaaagcttctctgagtccaaatttggtgttctctccactatatcgtgctgcttctacttatgggattgggaaatattcgggaattttaattgacaaaagtgaactgtgttcaggacagaacttaaaactaaggtagatattaagggaacaccctatagttcaatgggtgtttttctaggctatagatgaggagaatgccaaggttattacctactccaacaccaccactttgtggtacaaattaacaaagataccccccaaatctatgtatggttggcttgcacaaattaactttgtatttggcaaaaataaaaagccctcaggataatatttcccttatgtagtaaaatagctataatagaatttcacaatctttgttattttctgttgaaatgtccacaggaaaattagaattctgctaattgattttttttctgtatttataataagccctcatacaattgaagcatatctgagaaaactagaaatctattttatttatcttgtaatctgaaaagggagtgttataaaaattaataaggtttcctagagtaggaaataaaaattttaaaaatgaagtaatgataaacattaggctctttaaatatatacgaggcatatagaattacaaatcaacctggagagaccaattggagggaatgatgacaatgaaagtagatgcattttaggatgtttggcagattaatccttcagttttatcccttcagaggtatgagaggtcagtagcatgtctaaatgtaggcttatgttatttacttttcatcatcactgtgaggaagggtgaattttttaataaaaagaaaaaaactatcatagcatggagcttgctttttttaattggcagataattttacacttaatatttctctctcagctccatacgttatcagtttaattactctgaggcctcaataaaaaaattaaggaaactaaagtaggagagtttgcagtttacactcagctgttctgagttcactgaaagtgaaatgccaagctgccagggatctactgcatgaagctctcgtgaggctcctgagtgggccgagaagtggcagatgagcttcgtgtggatacggtaaagcatttagtgaaaaatgaaagtgaaagaagctaggctgcattcacaggctggcaggctttgccttctcagtttcaaacttgaaaaagggatctaggagtgactggtaaccattctgtgaaaaaaaaaaaattagctcaggaaggtgttgtaatcacaatggtccacactctgcagatcagtctcaggaaagagattggcatcctaacagaagacattctacttccttagtacaagattagggtcctccagacaggatgaattattgcaagtaattctgattgctgcttctgtttaaaaacaggctgctgcatcaggctagagaaggccctttgtaatgaagtaaaaatgggtgaaaattccctgttatgaaagaccaaaacaattagtgctcttctcttggaaaatataatagttgagtgagaagcttcaaagagctgcctggcccttccactccttttgccatgtgaggacacaatgttcatccattctacagtgtaaggatgcagaggctatgctcagtgtttttgaaatcaagaaatcataaacatttggataggataaatgcaaacctatttaccaaacccaagcatgttgaaaccttaatctgttcaggctgctctacctgagactgggtaatttgtaaacgacagaaatttattgcttacatttctagaggctgggaagtccaggatcaaggtgctgtcagatttaatgtctgatgagtgtttgctctctgcttccaagatgacacttcttgctgtatcctcacattgtgaaatggacaaacgctgtgttctcgcatagcagaaggagtagaagggccagggagctctctaaggcctcttttgtaagggcattaatcccattcatgaggatagaacccttatgacttaatcacttctccaaaggtcccacctcttaatacagctacagtaagaattaagtttcaacataaattttagaggactacaaacactcaaaccatagtaaagggtatctttgaagcattgcagaaacaaatggggaaagggaagtaccatacatgactcacagaacaacttatcctggaagttctaaagaaatagcatgtttaaaaagtgaagtgattcaggtcaactcatgcactatagatacatggttgctttgtaagagaaaccaaggaggaaaagccatcctttctacaaagcatcccttggtgactcccaccaaaaatagaatcacaaggctaaattgatcatgaatttggtattcttcatggctttagttttaaaaatatttttaaagtattaaaaggattagtattgaagatagtaatactggtaatggtttgcaaagcttcttgttcttgtcctactttggactccacctgcatttacacaaagtaccttcctgtcaaagtcatggacctagaaatccaggcttagtgcttgtggatgccatctggtatgggggtcagcttacggactttgaaactccacagatgtccaccacttattaactacatgatcttatgcaagctttttaatttcttggaggcttactcttctcatttgtaaaatggttttataatacctatcatacgggatccttttaagaatgattgacgcaatatatgcaagtcacttaacacagtgcatggtatccactaaatgctaagtaaacagcagctcttactattgttgtgagctaagtgagctatttatacaaccctggattcaaaaagttgtaataaatatggtggataaggtgagcccacattttcctaataaaactttaaaaaagttttatgaccattttgagtgtagctggacttttagaaatgtagacgaaacagtgaaatgtgtagttatgaaatttaatttgtttagttatacagatatattcaaattgtagatgatgcagaataatctcttcaggtatgatactttgcttttcctccccactatctcattttgtaaaacaattctattgaaacttcacgcgtatctctgacattggtgtttctagaagcactggagctaatttttgtgtcatctaacagttttccagagcatattacattcatgtccacctaagtttttagagatacaacactttaatctgtgtatcagagtatcaatgtcaggctttttccgcaagccacaaatactcatttgcataccactaggtccattggcttttccattcatcttgcatgtgtatattggtgatcttcgttaggtatttactgcagggaaatcttaagtaatctttcaaaggcttgtttacaatgatctccaacacttagtactatgacgtcacaccctgtaaacaattaataggtctgtgttaaatttcattatcttaactgccttccccaattttgtacgtttacatcataagcatctaaaacccatattaagttgttccagactaatgcgtgttttccagagagtacattattaagaataatttggaaaatgtcccttggaattaagcacttgaatgtaagacatcttcctctttttttctgcgagataacttgtagggagcaacgggaaggtatgctttatatttgtgaggataggaatagagattttcttgaaatatttatccaattatatgactttaaaatcatgcaagtttcttatttttattcatcgtatatatgtattaaatgccaggatgatccaaacacatagaaggtgaagttcctgccattataggaatttttggaccttagagaatatccaattccagaacaatgcatggaatactttgtggaaagcatttgcagagagaaagctgtgagttgcagcccttgtcctcaacaactgacagcaaatttgtcaacaaatttaattatgtttatatcaggcagaatgtgtttgaagggcctgcacacgtttcacatagggaaaagaaagaggtgaagagagaaatgttacatgtaaaaaattttacatagtaaatcatcacatggaaaaacacatttttcactggcaagtaaagaaatacaacaacaaagtaacaggtagcgacatatatgtattgtgatggctaagcactaagtgaggtgttggagaagctgtagagaaacaggtacaatttcaaggtggtgccgttaggtgacaattcatggaaatgtatacataaaacaatgttaagtgaaagaattagatcacaaaagagtatataaacgctgattatatctataataatgtgtgtatgttgacatctattgaaagaggatttgaaagaatgtaagtttaatgttgatttgaattttctctctgtaacagtgatttaaatgcatactaatttgaaaagaatacaatgaaaaatgactccccatcacacccctaaaacacataataactacacacatcttggtaaatagattgtggtagaatatgatgttcattgtttgtgatgttgcaacattatctataaatcaaggacttaattgaagttgtacttcccttctttatctactgtaagtctgatgaagcattttttgatcactgtttattatagtaatgagaaaagaataaatcttttccttataaatcctgacaatctgcattttaaatccttgcacaacctgaattctttgtctccactaaatgaatacagaaagtttaagcctgtgattgccttatttattctgcctccctacctttcaatagctactcaatagctctttcttgacctttacctgtcagttaatagttggtacattgagatgtgtttattaagtccaggcagctaagattcagatttatatgcagctaatatgctgaatgaactgaagatctactatgtaccacagatctttgcctggtactctacaaaggggacttcacttgatcttggtagtaaccatctgaagtctgaactattatccctattctgatgtgacaaaactaagcatcagttcagcaggcagtcctcttccgagcccaggacagtggtccttcccttgttccattgtgccttttaagtggctagtctcagtgtgttatagagaatagtatagttttaaacatataaaataaatttgtaggaagcagcatatttttaaggaagatctttttaaaaagacaagtgtgttgcttttttcctcatttaaaaaactgtatattgttgctataaaatttatttataagagtggttggagggaggccgaggtgggcagatcacctgaggttgggagttcgagacaagcgtgaccaacatggtgaaaccccatctctactaaaaagtacaaaaattagccgggcatggtggtgcgtgcctgtaatcccagctactcaggaggctgaggcaggagaatcgcttgaacctgggaggcggaggttgcaatgagtggagattgcgccattgcatgccagcctgggcgacagaacgagactccatctcaaaaaaaaaaaaaaaaaaaaaaaagagtggttggaaattttgatacaaagcaattcaaaattatacaaacaatttgagtagaatccaaacatgaagcaagattttctactactttaataatttcaattaaataaaagttaggagctgataaaaccgtttgagggtttatttaaaggggagcatgttattggcatgctgaccaataacactgggaatgtaatgtatcatgacatgtcagataacacaaacaaggacagtttttggaaaatcataaataacaaaatagaaggagtgtaaaatggaagaagcatcaaggggtggttggtacaataagatattaactctgagaaagttttctaactcatcacttaacattatgaatactgaattgggatgaccacaatactagcttctgtatgactccttaaatattgatattggaaatgtgcaccacatgataaccaatattttaaggtgggggcaaaatagctgctggtatgaatctctagaaagattaacttgaaaactgtcttgtgtaacaaaaggaaaggagaacatctgggaggagaaaggaaatttcctagaaatgggaaatgtggccataatgtgatttctttctataacccatgtatgcaaaaacatttatctccttttactctagtcacactatgtttgtggcttgcatgagtaagaaagctagatgaggagataattgttcagcaaaagaattatagagttgaaatcagtgaagtgaatggtattttatagcaaagagatccctaaaagtaggtggcataaagaatagatgcaaaaaagtattgctttctcttcgagttctaaagacctctgttgatgacgttttgctcatttaaattccagagaataattggaaacagagactttatgcgacagagctttcatttaacttgttcacctgacagttggctttgaatgatattttattaccaatcaacctaaattaaaatacccagctcactgtaaaaccctgcagacagtgtctggaatgctaaaacacataccatatataaataaaattaaggtaaggacaaagattgacaaaagcaatgacagtgaacattaacatgatatcagcagctttgagcttctatcaacaatgtggaccatgatgaagttaccagagagggcagtatagatggattttctaacttgcatttatcagaagagattttcacttttcaatcttaactatgtcttataccttttaataaagatgtggtatcaaacatcgaacatatatgtctgtacctacatgtaaatatatatgcatgtgtgtatatgcatagccatagctatccatccatccatcccaaagttcatctctccaaggtgctagtccacataattgcgttcagttcttctctggtctttgtataaatgtgtacttaaggactttgtggatagtgcgtgatataaatatggttcaggcccatcaaaatgcagattataggatccggtgaacttttccttaccaaataactgaattcctgaatgttgtattattataaaattacaaaagtttcaaacttactgctattctctaattacttctatagagtgattattatatgggatcaccagatgatcatggtctgtcatgctattgctatctttcttcataaatatataatttatcaaagcttaattatattattatccaataaatgaatgatagaataattatggttatgtggttcattacgttatgtcccattctctgactgaagcctctcagtttcatatctttgttgtgtagactatttatgacaagttaaatctgttctctggaacttagtgtcatcgtctattaaaatgaagggttggatttcaattaaataattcataaatttcctgtcagctctaaaattctatgttccattgattatcctcaaactattatacaagttcataaggccttctaatatatatatatatatatatatatatatatatatatatatatatatattagaagatagatagatagatagatagatagatagatagatatactagaaggccttatgattagaaggccatatgtgtatatgtatatatacacacacacacatatatatatgtatgtatagtgttcagttcttctctggtctttgtataaatatgttttatatatatattttaaaacactatattaatgtgcatgaattgagaactgctgtggtatctaaactcctttctgcttgactctatgatgagagatgaatgaatttggaaatatttagtccaagaaaagaaaaagtgtggggataatcagtcttcaggtttatgatgaattgtgactagctttcactctcttgtaaatgatagacaaagagagaacaaactgtaccaaatctcagaatgcataatgtgatagtgcattaaaaaatgctgtagaagctggagatacttagggaaggtagtcatttgatgcaaaatatcagttaatctcctctctagtgtgctttaaagccagggaatctaaaatgggggaagccaaggaggagtagagttgtttctcactgttcaacaggaaggcactttatgtattttcttatatattaattatttctgagctatttctcctaagagaaaacccttagatttggcctacagaagatgtacttatcattggcctttaatgatacagacattgccattgctaccaaagttagtttatatgtacaaggttatatttaattagcttatgtagatcaaaatgcaaggacagaacctaatccctcctcttcctctgtactaatcaatttataatctgaatgtgtcagaattcagattatgaattatgttgtatctattaatccttgtaaccacagcacattttataaaaatatacatactttgattctaaatgataatatagtgcacgttcaaaaccgagtaagtcacagttggtgggcacagagacattggtaataatgggatcctccagctagcaccaagtctctgttttttctttaatgttatatgatgaaggtaataataggtggccagtaaggataaaaagccacccaagaaagaaccagtcttaaacttggctcttttgcttttttcaagttttctcataatatattcaattccatgtaaatattgcaaacagctgaattgcacacattaacctaaacatgaataaaaaatgttgatattttatttaacctaaaaatagtagttatggataggctgcttttatgattatcgtctttaaaatatatcattttacattgggaatatagggaggattgtcaccgttattgtataataagaaaatttgttttgagtacattaaaaatacagtagatgattattgcaatataaggggaaaagttgtttgcttttgacagtctgtcagatgtagcctaggaagacaagtatggtagctgctttatataaaacagtaggagaaggacacaagctcaaagaaattttacctagctgctgttattaaagaaattcttttatagaatagaggctggttttttttttcatctttccgtttttgcttccatctctgaatcctttgctttcatatggcatgcaaagcgtctgtgcatggcagcctgtaacttctgttatttaaactgccaactgttaaaatggattgagttgaaccagaggaggaaaatagccccactgaggcaaatgcatttttacacccttctttaataaaatattgtaaggtatagctagaaagtttccccttggactttcatctaaaactgttagattgtagctttgtgaaagaatcattgttgactcctgtcagacagttttggagaggaggtgaagaggcttgtcttctgactttctgtgcactttgtcaaatcaggtactttgagcagaagtacgaagtgaaggctgatgtcagagaatgccttgaagcaggaacttgtgctagtctcctgtgacttcctttttttttttttttaaggaatcagattggattgtaaaatgatgggaatatgactggacataaacacgttcattgcaggctcagcagccgttacatatcattagtgaagggaggcaaggggcaagggggaccattttgatgtcagtttcattctttttaaagacaaatgcattcactgatgagaagtaaaccagcatctgtaaaattttacagacaagtaatattttaatgccttcttttcctgtagataaacgtataacttttcaataatcattaatataaactgaaataatgagtaattgtgttaaatacccataatgttggagctgcttttaaggaaaccagttatgaagcaactgtaacatcaagatcagtatatttctgttccaaaatagtctgtttcatagactcagtacatagcttgctgttatgccacttcggccacagttaatgccaaaatctaaaattttaaaggtgataatgctttttaataagaaatataatttggccttaactttccccttataaaaggccatattccatacacatcaactcaaaagtttgtcccattttctgacttttctttttctttatttgccaaagaatctctgtaattggcttgctctgcaaagcattttatttgcccttctgaacattaactattttaaagatccgagtgtattatggcagggaacacaagattttacttcaaccccttctatgccctcctctctactaaattaattatttctgttttgagtgttccagggaaagagtaaaattgttaaggtataacaggtaccaacgagtcatccaaacagaagtgccattccaggaaagtacagtatctgtgtgcccagcatggatcttggccctgccctacttttaagcttctaacatatcttcgtagtcatttcttctgtattgtgatttttttttaagtgagcacttttagatgtcccatatggtttaaaccaaatcagaaattcatgtccttaatgtttcgttagtcagaataattaagttgatagttcggggagcagttgaagcaaaataatggggtcattgaagcagtcaagctctaatgggaacctgagctcattcagataccaaatctaataattgttctacacctgtatgcccagtcccattgagcaaattcacattaaaggtttagtggaacagtttcaatgctgtggtccaaagggacttgctactgttttcacaagaaagcactgaatattttttggcaatatatatatatattttttgtgatgtgttaactaagctctgtgcatgtatgttggtgccctatccctacctagagaggaagaaaagggagagatgtattttcaggaatgtttttcttaccatttagggttaataaagatactctcaagcatttgccacctggaagcaataatatgagatgattaaactcactggatagtttggggagagggggagtttggttaatctatgcaaccaactagaaatgaagttcacttaaccctttttcttcataaaataaaatggtatcaaggtatcaagcatgtttttttggggtttttttgtttttttttttgtttttttttgaggtggagtttcactcttattgcccaggctggagtgcaatggtgcgatcttggctcactgcaacctctgcctcctgggttcaagcgattctccagcctcagcctcccaagtagatgggattataggtgaccgccaccacaccctgctactttctgtattttcagtacagacagggtttcaccatgttggccaggctggtctcgaactcctgacctcaggtgatccacccacctcggcctcccaaagtgctggaattacaggcatgagccaccgtgcccggccatcaagcatgattttggttattgaagtagaaagtagcaattaagcattgtgtagtaatgcactgtttcatttctcctgtgtcactatatgactgtaacaacaaactgactgcctttgattctcctgtaagatatctaaagagagttgacaaacctaaaaaaattaaaggtctaaagagtggaactatgaatttaattctgccgtaaactgaccattgaactgacctatctccaatagaactccctcattggaggattcaaagcacacaggaaaattaaacgatttgcaatttacctttaacaactatgaaatacagatctgaccagctttctttatcaaaaaaggcaatcaaagctgaattcacttacctaaagaatagttctaatacacatgaaggtattcattcaaatgactcttgtgctctaatatttttatttcctttggggaattcaaaaatcatttaccaaatgtctcttatattacaggtaccaaaaaaaaaaagatttaaattgcagttgctgcctttccagagctcacgataaaatgggggaagatagatcgcacagggacaatcacagtataaagctcaagctgaatcttaacagatgagtaggagtttcttgggtaggaaaagaaaaaggaagagaagcatgatccaagaaagggaacagcatttatggaggcaataggagaacacagtatattcaaggaagagccaactgttaacattgctggaacataggtatgagaggctggaaagatgaatagtcatgataggccatgtataattagttcgattattttactacatgggtgataaggagccatttcaggcttagacttatggtagcatggctagatatacattgtagaatgattatcttctaacgatatagaaggctgatagggtaagggtgaggctagagacaggagaaattcaatagggatctattataagagcctaagcaacagaagcataaggcctgcactagagcagtgacagtggagataatgcagaataaatagatgcaaaaatgattcaggggttagaattgactgaacttattgagcaactggatatgaggataaaaaagggaaggattctcggatgatttattgatttattttatgattgctatatgatagctgtagtaattttattagggctgctgtgacaaagcaccacaaactgagtggcttaagccacagaaatgtattgtctcatagttctagaggctacaaatccaagatcaatgaatgggttggctgtgccacgctccctgtgaaggtgttagggaaggatatggcccaggcctctctcctagctcctggtggttttctggcaatctttggcattctttggctggtagaagcatcacgttgatctctgctttcattttcacatggcatcctctcttggtgtgtgtttgtctccaaatgtttcctttttctagggacactagtcataagggattagagcccaccccaatgacttcattttaacttggttacctccataaagaccctatctccaaataaggttacctcattctgctgtactggagcttcagagatccaatatatgaattaagggggacacaatttaacttataagatggctctaatcatcaaagttaggatatataaaaaggagggaataggatgaaaggaaatgaaatcagtttaatttggatctgcagtgtgaggtagctttggaacaatcaggagaaatattgagaaggtgattgaagctgtagcttagagcctgagaaatgcagagttgagatccattagcatgcaggagatagaatagttagagcagttaagtttggcaattggatgagcatacccctgggaagtagctcatggaaagtatagagttaaaatatgggaaagggcaaagaataaagtgctgaaaattactaacacgttgtgaccaaaccaaactgtgtctgtctgcacacaagcaatggaaagccaaacaccaaagcactgtgtttttgcagtgagaaagtttattgccaggcagccaagcaaggcgataggagtcaggttcaaagctgtctcccatactagccttgcagccatggatggatttaagggagagattttgaggctgggatctgggggctggacagtgattgactgtaaggaaaagggggttggaaattcccttgggcatgagctattgaccatgcacgcttcttcatgggtcttatgttcagaaaatgatctgagggtggagattttggccctctgacatcaaaaggtcactcaccaggcaagcaagtctattctgtgcagactgcagtcagacacattaatgggttccaacttgtcccagactgtaagccagttttgttgcaaactaagggaattgtaacaaagtgttttgttctctgttctcctgcaagacaagctcaagaaattttgctacttaccaaattctcaaggaaaaggatagtagcatagaaacagagaaagattaaagaaataatttgagaatgaagaaagaataataatatacaagctaaaagaaaagagagtttcatggaaagaataattgtcaacagtgtcatgtgctacagagaggtcaaggaaaatgaagactgaaagaaaaaaatgttaatactgactgcagaatgtgatattgattcaggataggccaattcataaacaaagtaatcatggaacataccctgtattttcaatagaatttcactctacttgttactagagaaaagaatgaatttatttatatagtataaaatttttatacttataaaaattatattttttctagatcatgtagtttttctaatccataagaaagtcatatctcctattttactgtctttcaaaaggtagttaaataatcctgacaaagggaatcgtttagaaacaatacatacaaattctgccttggtcttgaaattttgatatttatggttatggtattttgcgactaatgttcagaataggataaaatagggcatctcagaataagattataatgtggttggtcagaagaaagtcttctaaggaagtatctttcacttcaagtcattgtctgttttttatgtagttaatgctggagctctcagggctgctaaatgtcattttatgtactacttcacaatctaaccatacatattaaccttttccttcaacacccctaagaacagaaagctgtctctagaaccagctttaaagattcacagttagacccagagtaaaagaacagattgaaaagatagtttgtaaactatttattgtcctgcacgaatatgtatatatgggaacaaatgacatatttctatgtctataaatccttgtaaaagttttattcagagaaagaatcagcatgtatttactacatggctatttaatatcgagaaagctaataaagaggtagaagaggctcattctctgccatcccagaactctcctcttagaaaggcaatatctgaaatgatagtgagcagtacgaaattggctataattgaaagctgaattgtgtgaaacaagctaagtttgtgctattggagtcgagaggagagaaagatcagcgaaggctagagggatcgggaaggtgggatttgagttgggctttgaaggataagtagtcttgaatggaggggaaggagaaggcaaagtgggtacataagcacaaatctggaagatatatagatgtgtttgtggaacagttgtgaagccaacctaactagattcaagggggaatagtagagaatgggagaaaatctgattggatagagtgggatctgtgtaaaaacaaacaatttttaaaaacccagaaaatatgtactccatgaatctctcctgtacttttttagctgccacaaattttggggccaaatttattacacatgtattctaatctgccgaagctacatcctttagtgtgaatctgttcacttttatcttcatatgtcttctcttgcagtgaattttaatctgagtccctgaaagttaacttgttaccatttttattgttgtttttgtcttttcttcaccacttcaaattaggattgaaccagattagtcttgttttaaatccactgcagccttttgagctggggagtacggtctctttgagaaaactgttttctttctttttttttttttttttagaactaagcatttgttgcagtttattggcactgcatatttttatttttatttatttttatttatttttattattatactttaagttttagggtacatgtgcacattgtgcaggttagttacatacgtatacatgtgccgtgctggtgtgctgcacccactaactcgtcatctagcattaggtatatctcccaatgctatccctccccgctccccccaccccacaacagtccccagagtgtgatgttccccttcctgtgtccatgtcatctcattgttcaattcccacctatgagtgagaatatgcggtgtttggttttttgctcttgcgatagtttactgagaatgatggtttccaatttcatccatgtccctacaaaggacatgaactcatcattttttatggctgcatagtattccatggtgtatatgtgccacattttcttaatccagtctatcattgttagacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgagtgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcacatgagtaggttgcgaaatttttctcccattttgtaggttgcctgttcactctgatggtagtttcttttgctgtgcagaatctctttagtttaattagatgccatttgtcaattttgtcttttgttgccattgcttttggtgttttagacatgaagtccttgcccatgcctatgtcctgaatggtaatgcctaggttttcttgtagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttctcaggtttgtcaaagatcagatagttgtagataggcggcgttatttctgagggctctgttctgttccattgatctatatctctgttttggtaccagtaccatgctgttttggttactgtagccttgtagtatagtttgaagtcaggtagtgtgttgcctccagctttgttcttttggcttaggattgtcttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctaaccatgagcatggaatgttcttccatttgtttgtatcctcttttatttccttgagcagcggtttgtagttctccttgaagaggtccttcacatcccttgtaagttggattcctagctattttcttctctttgaggcaattgtgaatgggagttcactcatgatttggctctctgtttgtctgttgttggtgtataggaatgcttgtgatttttgcacattgattttgtatcctgagactttgctgaagttgcctgtcagcttaaggagattttgagctgagacagtggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatactggcctcataaaatgagttagggaggattccctctttttctattgattggaatagtttcagaaggaatggtaccagttcctccttgtacctctggtagaattcggctgtgaatccatctgatcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagaggtctgtcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttggtgctataaatttccctctacacactgctttgaatgcgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttctttaagaatgttgaatactggcccccactctcttctggcttgtagggtttctgccgagagatccgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcatttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacatagttctcgagctttggtcttcagctccatcagctcctttaagcacttctctgtattggttattctagttatacattcttctaaatttttttcaaagttttcaacttctttgcctttggtttgaatatcctcccgtagctcagagtaatttgatcgtctgaagtcttcttctctcagctcgtcgaagtcattctctgtccagctttgttctgctgctggtgaggagctgcgttcctttggaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggaggcagtctgcccgttctcagatctccagctgcatgttgggagaaccactgctttcttcaaagctgtcagactgggatatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaatcagcgagactcggtggggtagggccctccgagccaggtgcgggatataatctcgtggtgcgccattttttaagcccttcggaaaagcgcagtattcgggtgggagtgacccgattttccaggtgccgtccgtcacccctttctttgattaggaaagggagctccctgaccccttgggcttcccgagtgaggcaatgcctcgccctgctttggctcgcgcacggtgcgtgcacccactgacctgcgcccactgtctggcactccctagtgagatgaacccggtacctcagatggaaatgcagaaatcacctgtgttctgcgtcgctcaggctgggagctgtagaccggagctgttcatattcggccatcttcgagaagactgttttcaaagctggattagagattgactagaaaggaagaaagcctgagtatagtgattagtctacccaatgcattgtttctcaaattttaggtgtagtaaaagggatctgtggatacattttaatgagaacctaataattttgggtccccagtaatcgacttagacttacttttaatatattgttgcttaaatataaaaataggcataaactctatatgctttaagaattttaataaaacagataaaactaaaattaatgttcacttaatgtgcctactgattctagatttaatagtagagcttcagatccacttatacctttttttgaccttatcattacaaatgcagaacatccctgttgtataagtaggctgaacaaagtggtactagtaccatcagtcaacattttgtgatagaattcagggtcatcagactccataccaaatgaaaattttggtagagagcaactctcaaattccagttttaataggatgtctgctccagaaccttgtaaagttgtgttgctcacatgaagagaaggctaggattggaatataacatgggtatttaatccatttactgctggaatcaggaagcaaaaaagtattcagtacatatttaccactcaatttttagatagtgaacaattgcaagttggtccacaaggattacatccgtataatacaactgatcatgtcctgaagacggtactgactgttatgtcacagttctcatatgtccagcttgcctagactgttgtgtgaaagagcattgcaccctgtgatgactcaagtctctgaaaaattttctctcttcaaattatcatgaaaccttcattagtacagtgcacaataatgttgcttggcttttacgtaatataaaagcaaatatatataagcctttttgtatatcagtgatcagtacactagtcactcataaggtgatgatgcagggtatccttatgtaaacactttttactgtaccataaagtgaaaacacaaaactgtaaatataccctgttttaagaaataatgccctagtgagctccactgactttttttttttttttttaatgaaattggctgcaacattgggaattacatcatgtaattaatatctttgttacattgggctcttttagaacagaaacttactctggaccccttaagaaacaaaatgaattttacttccttctgtgtgtctgttcttttctatttatctttcaactggcttactgccctattgagtagtgcctttcatcacaaatcatgccatgtgttacctatgaattggctgcccctgaaggaaactgatgtccataatggtcccttcattggccactgttgagggggaaaaagcctatttagtactgctttcctaagtaaaaaaaaaaaaaaactattgagggtgatggtttcagctagaagtggtgttgggtacatcgggcacaatgacctgaggcaactgtttgcactctaagaaaatatcacccctttcagggtcatgggaaatccaagtgtaagttatattcattgcctccacttactcctcaaccttctgcaatctggcttctgctccccttatttcgaactgaaattgctctcattaaggtctctaatgacctccatatttctaaatctgatagtttgtctttattttactgcatctttctacaacatatgatattattgcttattccatttttcaaaatatctactcccctgaattccataacgtgtactgtaatggttctttctatgcctctctgaatatttgctgttttgtttcatggactcttcttcctatacttatctcttaaatgtcactgtttcccaggatttgatcattagcccactgcttttctcactttacgtacattcctgaatgatggctttgataaccatctaccatctattacccaaatctctctcactcttttcaggcctctcccctgaaccttggtcttgtaatatttgtaacggcctgctgggcaggtccactcagatgttttaaaggcatacaaattgacaaatccctaactgaactcatcatcacctggaatgcacctttttctcctatatattcttagatgatggaaccaccattctcccaaacatataggctggaaattttagagtgatcttggactccttttctttaattttagagtgatcttggactccttttctttcctacatgtccaatgaatccctaattattgtcttgtgcttattaagttcacctactgcatgatcaccaaactgaactgtcttaccacttcactccctattgcatatctgaagttcaagagccttaaaatgacacataagcccaatctgtgttctaaccatcatcccctgcttttaatcaatactgattttgtttgtcatcttcacacacactttttttacctcatattttctcttcctttcctcacagcatctccttttcctggaatatacttttcttccaggataattcatccatatcctttaagaatctacaacaatattgccttctctagaaagtcttcccaaagatgcttcccctaaggcttggctgagtatttaatttctgtactcctgaacagtatacccctcatcatagcacacactataactctcttctcattatctttgtatgctaaccgcatttgagagagaacaccatgaggcaaagggctgagacatttcattttggtatcaggggatccaatataatctaagttctcaaactgactcactgagaactatataacagagtaaagagaaagccttaatacatttccattagactaatttttaaaccaaaatgccacaatcactacatagtacctgccttgaaagactggctcatttatctctgtatccctctagcactgtgccaggcacatagtcaatgttcaagaaaagatggttgaaataaattgcaggccagtttttggacagagggaaatatgcctgacattggaacagactctgcttatgacagcaaggctcctcctctttcgagtgcataagtctactcaggaaaccgaattgaatttcagcaggttgcctggtaaatctgctgtcctagaaaaaaaaaaaaaaatgagtgaccggttttgctagatgcatcattcaagccaggctggaatctctagaaataatctctttctaccctaaaggacaaatctgtccagacaactggaatcctaaagcagcgaagtaatagaaagcagtctggcaacatttctatacccactggatgacaataagaaaaataagtaaatagttatgaaagattttcattgcttctcaagggcataaaaaaaataccctcgcctatgatgacttgtgaaatagagttagaaccttgataaattctgacttctggctgatctttttaagtctttgttttaataggctaatctgaaaaatacttctataaacatctgtttgcatctaatctcattgtcccaaaagtgactaaaaaatgtcatagtaccataatgaggctgtctagactttgaaaagtgtaatatgatcgtgatgctaaaatctttggaatttggctctcacaatatctaatatttaaaatgttcagctttttctctgtatcgggtgccattctggtcattttactttattgtttcattactaaagtctttgtaactgccctgttaggtgggtctttaatattatttttatgttcacaaggggaaattaaaatgagaaaaacatagctcttaagtggcagaacaaagatgtgaacccatatgtatggccatacactgagaactttgacctgtcacgctaaattgtgactatccattgtaagtagaaacagttttttgcttgaggcttgtttattgatttgtgtgcatgctcttcacatccatcagaagattagtatgggccaggtactagattacctcatttagttctgttaatactcttcagtgtaagtaccattattatccccatcttacgaataaggaaactgctgtttagaaaggttcattttgcgaatgcataaacgcaaagtgggcctaattggttaggaaacaaatgagtctagtagtctacattaataagttcaaagactacacatagcagttagctttactttgctccattgttataagtggtaagaaagaatataatgcttagtgctaagacttccctttccaccccacactgcctgcactaggaagggaaaattaacccggaatgcatgctttactaaacatcggtcagtaccttttaccatcaaaggacagactttttttttttttgaagtctcatgtgatttttatcattgaagtaaaactctctccaggtgatgtaatgacatacctcctattttttctggatttttacccatctgtttggagagagtcaatcttttagagagaatgactttttaagactttaacttttagaatttataatctaagatacgtgaaatacctttataaatgataactgtgtggacacaaatttattcatgttctaaaatttgtaagccatgactttcccatcagggaacattccacggcccttactgaaacagggcagaaaactggcacctgttttatatcctttttttctttccattatagtatacttagtgatggtataatcaacaaggaattagtttagagattattggatcctatgctactctttcttaaaattgaaaacaatatgtactttgtagctaaagactgagaatttaacatcctatctagattttgttctctagtttgacaaattaatcatgctcaatgccaaaaattcagatattatagaaatatatatatatatatatatatatatatataaaagaatcagatggttgcggtggctcatgcctgtaatcctagcactttgggaggctgaggtgggtggctcacctgaggtcaagagttcaagaccaacctggccaacatggtgaaaccccatctctactaaaatacaaaaattagctgggcatgatgacgggtgcctgtaatcccagctactcgggaggctgaaacagaagaatcgcttgaacccaggagacggtggttgcagtgagccaagctcgcaccactgcactccagcctgcacggccgagagagactccatctcaaaaaaaaaaaaaaaaaaaaaagagtcatcccaccattcatagatagccactattttttattggtgtatatccctctaaactttaaaaattataatattataaattatatttttttcaaaaagcagattatgacatactcttataacttgcctttttcaccttatcatatggacctctttttatcaagtacatgtagatctatgtaatagtttagattgactgcatagtatcccaatgtttgtaggttccctgttttgtctaatcccatgatggacatattggttatttatgatattcattagtataaacaatgctgcaaagaacatcagtgtatgatgatctagctttatacatttatccgataatgtgaggactggctttgtcccaatagatgtaaatgtcaggaatgattctttgagacatcttatatgagaagcaagttgctaggttagtagccatttttattcatgtataggctcagcctggcactcaggttgtgcatggattgtgttagacactagaaatataaaggaacttgtgccaattatgaatatggaatcaagaagctgtgttttaactgtgtcctaattgttcatatttaaaacaacttttgactggcttctaccttaagggacaatttgtattttaaaacaatggcaccgacagctgttaaagtgtgtgtgatattaaccatacaggttgcctttgttcatacaactggttaagtaattaagcacaggctagcatggggaacattgctaatgggaagcacctgtttatagactcttgcattgtaagctgtaggttaagtatcttttatcaaaatcataggcagtggtatatttctgtgatctggttctttgggaaatggagacatcatgcagggtgaatgaacgactgccatttctgcctcactgctgaaactagcgagcctgcatatcaagggtacctgggcttacttaagctggggagttggactgactaccctaaaacttccatcatcagcaagaaatacgtagcccagacccaagagatgggttgcacatgttaaaaacaaaaagagtagatacatggtcttagagtgattcagaaacaaaggcagatgacaggtaagtgtattctaagtcagcatatcagcaacaaagttcaggcagatcacaaacaactgcctcagaaaatgacagaggattgtccatcatgtgctcaaagttagagaaatggctgatgcctactattcttagtcataggcatatatgccacacatggagtagaaaggcacagagatgacaggtgatagtaatgaattgaccttgtagccaccatgccgtttaacagctagtttattctccaccaacccaaatggctgcttgagctctcaccctgccaaacactcctggcccaggttattgcaatctatgccttcatcggcttttctactgtcactcttgatactatctaggatatctaggcttcaacaatagaacctcttcggaagatttcagagagcccatttctgctcactttttaaagcagaactcctgttttctatgtaaatgcttcaagactgtttttttaaaaaaatagaattaaaattaaaattacatgtttattgaaacagctgtcactgtcttagttctaataactacaagtccagtcagtatattttatttcattattttcttccttagaaaataaaggttaaatatgtatagacattctggttcttcctttatacattcattgcttttcataccctctttgcaaataggaaacatttagtcattaaatagcaatattcgagaactagaattccctttttctgctaatcaaaaattaacagctatctttctgtttcttcttgttgaaatccccctatcttttaaggcttaactgggaagaagttgtccctgactcccagctcctgtactcaagggatatgatttttctccactttgaacctccattgtacttaaaatgtaatagatgctacaagagacaatatagttagtttcatgttctagttgttggtacatttatcctttctaccctcataatgtgcaagggtgcctgttaaggtaccctgcagatagcttatgcagtaacaacgtgtggatagacagacagaagaaagcctttcctttccttgtattaatgtcaaaatacattccctctgtgaaagcagcagagctgaaggtgaattcaaggatcagtttctgatttgatgctaatgattggatgattatttaatcaacagacaagtttctagaaactactatgtataagccactatcatagacaccttgagcatctctgttgtagtttgtgtggtttctgttagcttgctcttcaatatgtttcacatatataacttccttggaagctttaccagctattgcctaactttcttcatatatttatttgtcacctttttctgtattttctagatatgcaggcatcctcatcagactttgaacatcatagagagaaaatctgtcttacgacccaattgcattctctagtaaagaagcaaacataatgcatggctcatatacaaaaccaaggacatttaaaaaaatctattcactagctttgacattgagtccaaagataatcaatggcaaggtctgtggcagttgaaatactgaacaatatactgatgtaattttttcttaaccatacttttctaagatttcttgaaatgcccatgttatcaattatgtaaatgccagtcattcagaatcccaagagattggctgtacatgttataaaaatatcatgtttatggtagataaaagtaagtattgcatattttctacatttgtagtttaatgtggatacatttttaatgccttgaattaatattattgtactatgtgattttacttttatcaggtatttcaatcttcctaaagttactataattgagtttgtttgataatgtacctttacattagtacgagacttgatagtttgcaaaatatgaggttcataatagagatggagagtagagttactacctggcagggaggataagaagaaagtgaaatatagaaaagtgatttaatctcactactgcagttttgtaaaatctaatttgtttttcccctagcacagcagagtttcatgttgataacaagctactgaattaataaatccattgcaactattgagatttttcctttaataacataacgaatgctgagcattaagaaaaggaaaggcgttctttgcacagaagttacctctagcagatctacatccctatgcataggaacaataccaacatcataccgtgaacaatatcaatgtgaaagtaatttgtgcatctcaattagaatactgtattttctacacaaaagcactctgtttcatggaacacatttgcttattttccaattggaaagacatttgggggtctattttgttatcattacatgtgcttaactccaattacagttaatgggagtcgtgtgtctatagtcacagtagcctctgaactattttaacattattgctttccattaccatcctcgttaaaataactttcatctcttctaccaacctgaactaccacagtaatctaggtttctgttttctttgcacggatttatttgcatgtaatgaaggatacagattacacaacatgacctgtttctagtttgcacattataatgtcattgagattagaataggtctagaactatttaattgctaagtggaggtaatcgattggcttctagacgagtacccattgggtttgtttatctagctgtgttatttttaagttgttttgggattatagcatgtagagttctaaaatgtgtcctaaaaaatacatagtttaaatgaaaatatgagtaatggaggtttaactccaccagatattaaaacatctcatgaggctgaaataatgaaatcaggagctattggcacaaaaatatggaataatctcaatgtcaatggaacagaaacccgagtatagcaatttatatttgataaaggaggtaacatgaatcattatagaaattcatgattattcaacaaatagtgcaggaacagcccatctcctctttgtaagaaaaaaaagaaacaaactggtgtggaaacttacctgacattgtacaacaaaatgaattatagataatttaaatagttacatgtaaaaaaaaaaaacaagttaaaccttaaagagcaagaactcatatagttgaatgtttgtcacatgtctctggctagagaaggactttctaagcttaaaaacaaagaaacaaatcacagtgtaaaagattgatagatttagtttcataaaaacagcaaaaaatgaaaccatatattcctaaaaacctacaacacaaaataaataacaatcaacaagcaatcaacaaacaaaggaaaatatttctaataaatatttcaattgtttagtatccctaacatgtaccatttaaaataaaaacaaaagcagaaacctaagatcccaatagataaatgggcaaaagacatgatcagtatagaaaggaagacatatgaaacgttccacctaattagtatttgaataaatgcaaaaagaatgaatcagatgcaattttttcactttttatattagcacatttttaaaaagattaatacctaacaaagagataagatacacaaattcatatactgccaattggatttaaattaatacaactattctggaatacatttggacttacttttgcataccctaacaatgccacttctacatatggcatatgtaaagatgtaactgtcatgttccagaagtttaatgacatggaaaatttctacaatacaatattaaatgaaaaggtagaacaccaaactgcatatgtagtttgagctcagtatatatatatatatacgtacacatacacaaaagacactattctggtcacagtgaggagaaagaatctggtcaactagtagagcaattggctgtcccccacaaagagattaggctcaagcctaatttggctgccaccttgcagtcatttctggtgagtaaaaaactatttccaagtcaggatttctaaaatcacagagaaaagcataaataaaaccattttggacacaagggggaaaaaatgtaagtccatatgagatgatttcagtataacagtccaaaataaatcatctttctctcatcagtgcttgggatgcaaatagctactctatggacatttttggaagcaacataaaaagttttcttggtttccttagcctaagctgcaatagacccagacctctacttgctctctttgccagaaacaatgcctgaccactgatggtaaatctgccacattgtcactttcaaagggctttggagaaagcaaagctcattgtaaattacagagggtttcttttactttgttttctagcctactaattggcattaaaatgggatattttgtaacactatgtatataagggtcatagacttcgtttatgttatcctgctgtgagggactagtatataatgttaggtcaacactggtatctctacatgcctatgaagcaccatagggaaagaaacagccttcccctaggcaacaacagatggacgcctaaccttgtggggaatgaataatggacgtggcccttttataacagtttttttcaatcccaagtttaccgcctcatgccatattcaagatacagccttgtacttttggcactcgctcactgtgttagaggattgtttgcacactcccaggttacataatgcagctcgagtcctccagtctatctcatgtcacattgtgtttaagctttatctgtattgtgcttattccccagttatttcacttgacaaagtcttcggtaagaaggaaattaatgatgtagatttaggtgtggatctgaaactttgtgacatccaggtattttgtggatgatgtgctttgtacatagttgctgaataaatgattgcatgaatgaattctgaagcaatactataatgggtttagtccatttactgcaggactcagttaagaaggttttgagatgaatgccaaatcaatttatgcttagaaaaggcataaagcttcttactcatatgacagcagggaaagccttgacatctgtttgagctggttaacctgatattcagaagctgcagaaccatgtttaagctgggccatggttttatattcctttttagtgaaagatttgaatattacttttgttttggccacgctttctccataggatgcacattttcttttctttctttctttttcctctctttctttctttctttctctttctttcttttctctttcttcctttttcttttctttttcttttttcttttttgagacagagtttcactcttgttgcccaggctggcaatggcacgatctctgctcaccacaacctctgcctcccagatttaagtgattctcctgcctcagcctcccgagtagctgggattacaggcatgcgccaccatgcccggctaattttgtatttttagtagagatggggtttctccatgttggtcaggctggtctcaaactcccgacctcaggtgatctgcccacctcggccacccaaagtgctgggattacaggcgtgagccaccgcgcctgacccaggatgcacattttcatataactatgttcctgtcttcaaccttatgctttaaccaggtcactcttcatagtatcagaatctattcaccttcacatggggcacatttcaaagcctttgatgaacaaaaagaatctgttagcgcatgcatagccggctctggtagatttggaaggtccattttgggattgatttctcaggcttattgctgcattaaggctcatgtttacaaacattagaatcccttaatgaattcttagaccataatgtgttagtctatgaattaagaaaaatgaagcagatgaagaatatgacaaatcatgttaccccatcctccaatcaagcgtgtttttctgtatttcattgcacaatgtccccaacaagcatatatacacagacagaccctcctcttccatttttctctctttgatttccaaaaagataacaggcagattggaagggataccactacttgttaacaaagccctccatataatctcaggtaaatacatgtgttgtcaactattgactttttgaaggagaagcctgtatttttttcacttaaactatactagtattaggagaatgagactagttagaaaagtgaattggattcaggctgggtctcatggagctctcagatcatatcacatgagcacccagtttctccacctgtttccaaagaggacatacaatcatggccactatcacccaaattaatgtatatcacctctggcagcaatcatatctaacatttgtcctttcctcataaatgtgatgccaactatgagtcctgaccttataagggccaggccactgctttttccccattcgtttttaatactataaatataaaagttgtatttcaaacaattgagtgattttcaatctctgcttaaaaaacatgactccaaacgtggaagtcgtcatcattagattgctagccactagaatgtgaagataaatgaaatcaaatttacacacacacacaaacatgcagagtataagagtatatatatgtatatatatttgttggtttttaaactaaattagttttaacataaatacagagagttggaaataaaagatccagatcagccattgctgctattgtttctaatgatatttttttcataaacgttgtaggttgacattgtgaaaatgtaagtggcaacttttacagaattgcttcttataattatctcattaatattgggacaaattaggcatccagagaggtgtgggaggtggaggcaaagaaggaaaggagaaaggaataaagggagggagaaaatctagaataattctgttttgtgcatgtcaaaagctggatttaggccctgaactcaatgtttatcctgccttgcaaaagcttccatgtcttttcgtcagtttgttttgacccgaaactttgttttctcacaccagatgacaccagtaagttgcaggttgatgtgaagccttacatcccatcatttattgctgcaaagctgggtttttggatgtggtacttgtcttggacccagtgggtagtgagtgatggtgtggggtgccagtagcattactgaagtgaagtgtggatgcctgttgaccttagtgtgtaggaccaccaaggcacaagccttttttcaagtcagcatgatcctctgggaatgctaccgtcattctcacgtctggtagctttaacactgaatactttcatgctagcaatgcggtgggaaccattgtattgtaatctcatttttaaatgttttctaagaagtagaaaaccaatctgtatgcaaaccagtgacatctaagtaataagtcctttattcgggaatgttatcttcacatttttagctgaattgtgatccatatctcaaactaaataatggattttttaatggtatcttcaaaaggacacccaaataatccatcactcagatatatctctgagtagagaaaatgcctctttctttctcacctctcagtgatattattgcatcatgaagcactcagtatgctttaagtttatggctggttggctcaggacacataccgtggtgttaatgaggctggggtcatggaggcccgttagctttgctctgtttgctgaccacagactaccgggaaatcagtcaagagatgctagcacagacaagaacggcaccatggcaaaacctcagtagttctcagtttttcctccccatacaacaggcaggatgtgttagttgggcgtcatcatctcaaggaggaaatgagtagcagcttgggaggccccaacctttaactctgaacaaagcaggcctgacatttaggcattaactttgcattataatcccccatcataccattgatttgctgtgtaaccttcatcactaaagcagagataataggatagaatgaaatgggcttacctcccggagatgttgtgtgaattagcaaattaacgagtgtaaagtgttagcatttatgtaagtgctggtggttgtcattatttctagggacctagtctcattctaaatagagaatctaagtatattatgcttttgtcagaaagggattttcaccccacatcaattgcatttaagctgagcataaaacagaggtgataataacatagtagtgatcattgcaatgcagagctgtaaaccttttccctattaaagctagaactattttcagcaactttcaatgcttttaaactttgttttccaagttttgttatctctataataattattcttcctgtgatgggtggtgggaatgggacctggaataggtcctattcattattcattcccatgatgactatataatatattgaatttttttacatcatacaatcaagcaaatttggtagctagtgtgattgccacatattgcaatcattgtaaaaaataaaaactcttttctgctctgcctatgctggtgtcctctagaggtagccaacatacagattgaaaactcatggggaattgaagtgctttccaacaaaaggtgctgtatatagatcttttcaatttaacatctttaccaaagaattttgttgttgcctgctatttccaaggggactgtgcttgagagactgcttccatttcttttatcactctgacttcgcttaccaagaaaagtcatttattgctgattgcagaactcttgaactcagccgggcagctgccgcatgaactcctcagatctgagttccttgttacttatttacattttcatttgaagtgatttttcaggactatttgaaaacctttctcaacctaacatcatgtaatagcaaagatctaaaacttaccatgcttttggtcctttttctgtttgtcttacagataacagacgagtacctttggaaaggtcacgctctcgccacaatggagctatctcatctaagtga
